US006967092B1

(12) United States Patent
Mc Kearn et al.

(10) Patent No.: US 6,967,092 B1
(45) Date of Patent: Nov. 22, 2005

(54) MULTI-FUNCTIONAL CHIMERIC HEMATOPOIETIC RECEPTOR AGONISTS

(76) Inventors: John P. Mc Kearn, 18612 Babler Meadows Dr., Glencoe, MO (US) 63038; Charles A. McWherter, 16564 Thunderhead Canyon Ct., Wildwood, MO (US) 63011; Yiqing Feng, 423 Mission Ct., St. Louis, MO (US) 63130; Neena L. Summers, 1203 Saddlemaker, St. Charles, MO (US) 63304-2423; Nicholas R. Staten, 859 Queen Ann Pl., St. Louis, MO (US) 63122; Philip R. Streeter, 1555 Pond Rd., Glencoe, MO (US) 63038; Susan L. Woulfe, 1719 Woodmore Oaks Dr., Ballwin, MO (US) 63021; Nancy I. Minster, 16080 Clarkson Woods, Chesterfield, MO (US) 63017; John C. Minnerly, 5824 Bristlecone Ct., St. Louis, MO (US) 63129-2916

( * ) Notice: Subject to any disclaimer, the term of this patent is extended or adjusted under 35 U.S.C. 154(b) by 1123 days.

(21) Appl. No.: 08/957,610

(22) Filed: Oct. 24, 1997

Related U.S. Application Data
(60) Provisional application No. 60/029,629, filed on Oct. 25, 1996.

(51) Int. Cl.[7] .......................... C07K 19/00; C12N 1/21; C12N 5/10; C12N 15/62
(52) U.S. Cl. .................... 435/69.7; 435/69.4; 435/69.5; 435/455; 435/325; 435/252.3; 435/320.1; 530/350; 530/351; 536/23.4; 536/23.5; 536/23.51
(58) Field of Search .................. 530/350, 351; 536/23.4, 23.5, 23.51; 435/69.7, 69.4, 69.5, 455, 325, 252.3, 320.1

(56) References Cited

U.S. PATENT DOCUMENTS

| | | | |
|---|---|---|---|
| 4,703,008 A | | 10/1987 | Lin |
| 5,376,367 A | | 12/1994 | Williams |
| 5,420,247 A | * | 5/1995 | Gearing et al. ............. 530/350 |
| 5,554,512 A | | 9/1996 | Lyman et al. |
| 5,635,599 A | | 6/1997 | Pastan et al. |

FOREIGN PATENT DOCUMENTS

| | | |
|---|---|---|
| EP | 423 980 | 4/1991 |
| EP | 0 627 487 A2 | 5/1994 |
| EP | 676 470 | 10/1995 |
| WO | WO 91/05795 | 5/1991 |
| WO | WO 92/04455 | 3/1992 |
| WO | WO92/06116 | 4/1992 |
| WO | WO 94/24160 | 10/1994 |
| WO | WO 94/25055 | 11/1994 |
| WO | WO94/26891 | 11/1994 |
| WO | WO94/28391 | 12/1994 |
| WO | WO95/21197 | 8/1995 |
| WO | WO 95/21254 | 8/1995 |
| WO | WO95/27732 | 10/1995 |
| WO | WO 96/14410 | 5/1996 |
| WO | WO 97/12985 | 4/1997 |
| WO | WO 97/38101 | 10/1997 |

OTHER PUBLICATIONS

Chaudhary et al., Nature 339:394–397, Jun. 1989.*
Bowie et al., Science 247:1306–1310, 1990.*
Reeke et al, "Three–Dimensional Structure of Favin: Saccharide Binding–Cyclic Permutation in Leguminous Lectins", Science, Nov. 28, 1986, vol. 234 pp 1108–1111.
Luger et al, "An 8–fold Ba Barrel Protein with Redundant Folding Possibilities", Protein Engineering, vol. 3 pp 249–258.
Cunningham et al, "Favion versus concanavalin A: Circularly permuted amino acid sequences", Proc. Natl. Acad. Sci. USA, Jul. 1979, vol. 76, No. 7, pp. 3218–3222.
Protasova et al, Circularly permuted dihydrofolate reductase of E. coli has functional activity and a destabilized tertiary structure:, Protein Engineering, 1994, vol. 7, No. 11, pp. 1373–1777.
Zhang et al, "Circular Permutation of T4 Lysozyme", Biochemistry, vol. 32, No. 46, 1993.
Luger et al, "Correct Folding of Circularly Permuted Variants of a Ba Barrel Enzyme in Vivo", Science, vol. 243.
Hahn et al, "Native–like in vivo folding of a circularly permuted jellyroll protein shown by crystal structure analysis", Proc. Natl. Acad. Sci. USA, 1994, vol. 91, pp. 10417–10421.
Lin et al, "Rearranging the domains of pepsinogen", Protein Science, 1995, vol. 4, pp 159–166.
Yang et al, "Aspartate transcarbamoylase containing circularly permuted catalytic polypeptide chains", Proc. Natl. Acad. Sci. USA, 1993, vol. 90, pp. 11980–11984.
Vignai et al, "Circular permutation within the coenzyme binding domain of the tetrameric glyceraldehyde–3–phosphate dehydrogenase from *Bacillus stearothermophilus*", Protein Science, 1995, vol. 4., pp. 994–1000.
Goldenberg et al, "Circular and Circularly Permuted Forms of Bovine Pancreatic Trypsin Inhibitor", J. Mol. Biol. 1983, vol. 165, pp. 407–413.
Hemperly et al, "Circular permutation of amino acid sequences among legume lectins", TIBS, 1983, pp. 100–102.

(Continued)

Primary Examiner—Elizabeth Kemmerer
(74) Attorney, Agent, or Firm—Winstead Sechrest & Minick PC

(57) ABSTRACT

Disclosed are novel multi-functional chimeric hematopoietic receptor agonist proteins, DNAs which encode the multi-functional chimeric hematopoietic receptor agonist proteins, methods of making the multi-functional chimeric hematopoietic receptor agonist proetiens and methods of using the multi-functional chimeric hematopoietic receptor agonist proteins.

37 Claims, 12 Drawing Sheets

OTHER PUBLICATIONS

Kreitman et al, "Circularly permuted interleukin 4 retains proliferative and binding activity", Cytokine, 1995, vol. 7, No. 4, pp. 311–318.

Li et al, "Degradation of Ornithine Decarboxylase", Mol. and Cel. Biol. 1993, vol. 13, No. 4, pp. 2377–2383.

Ritco et al, "Is the Continuity of the Domains Required for the Correct Folding of a Two–Domain Protein?", Biochemistry, 1995, vol. 34, pp. 16543–16551.

Garrett et al, "Are turns required for the folding of ribonuclease T1?", Protein Science, 1996, vol. 5., pp. 204–211.

Komar et al, "Kinetics of translation" FEBS Letters, 1995 vol. 376, pp. 195–198.

MacGregor et al, "A circularly permuted a–amylase–type", FEBS Letters, 1996, vol. 378, pp. 263–266.

Koebnik et al, "Membrane Assembly of Circulary Permuted Variants", JMB, 1995, vol. 250, pp. 617–626.

Buchwalder et al, "A fully active variant of Dihydrofolate Reductase with a circularly permuted sequence", Biochemistry, 1992, vol. 31, pp. 1621–1630.

Viguera et al, "The order of secondary structure elements", J. Mol. Biol., 1995, vol. 247, pp. 670–681.

Mullins et al. "Transposition of Protein Sequences: Circular Permutation of Ribonuclease T1", J. Am. Chem. Soc., 1994, vol. 116, pp. 5529–5533.

Horlick et al, "Permuteins of interleukin 1B—a simplified approach for the construction of permutated proteins having new termini", Protein Engineering, USA, 1992, vol. 5, pp. 427–431.

Kreitman et al, "A circularly permuted recombinant interleukin 4 toxin with increase activity", Proc. Natl. Acad. Sci. USA, 1993, vol. 91, pp. 6889–3893.

Hannum et al, "Ligand for FLT3/FLK2 receptor tyrosine kinase regulates growth of hematopoietic stem cells and is encoded by variant RNAs", Nature, 1994, vol. 368, pp. 643–664.

Lyman et al, "Cloning of the Human Homologue of the Murine flt3 Ligand: A Growth Factor for Early Hematopoietic Progenitor Cells", The Am. Soc. of Hematology, USA, 1994, pp. 2795–2801.

Martin et al, "Primary Stucture and Functional Expression of Rat and human Stem Cell Factor DNAs" Cell, 1990, Vol. 63, pp. 203–211.

* cited by examiner

I. Construct tandemly-duplicated template

II. PCR-amplify tandemly-duplicated template

```
     GCCCCACCACGCCTCATCTGTGACAGCCGAGTCCTGGAGAGGTACCTCTTGGAGGCCAAG
  1  ---------+---------+---------+---------+---------+---------+  60
     CGGGGTGGTGCGGAGTAGACACTGTCGGCTCAGGACCTCTCCATGGAGAACCTCCGGTTC
     AlaProProArgLeuIleCysAspSerArgValLeuGluArgTyrLeuLeuGluAlaLys

GAGGCCGAGAATATCACGACGGGCTGTGCTGAACACTGCAGCTTGAATGAGAATATCACT
 61  ---------+---------+---------+---------+---------+---------+  120
     CTCCGGCTCTTATAGTGCTGCCCGACACGACTTGTGACGTCGAACTTACTCTTATAGTGA
     GluAlaGluAsnIleThrThrGlyCysAlaGluHisCysSerLeuAsnGluAsnIleThr

GTCCCAGACACCAAAGTTAATTTCTATGCCTGGAAGAGGATGGAGGTCGGGCAGCAGGCC
121  ---------+---------+---------+---------+---------+---------+  180
     CAGGGTCTGTGGTTTCAATTAAAGATACGGACCTTCTCCTACCTCCAGCCCGTCGTCCGG
     ValProAspThrLysValAsnPheTyrAlaTrpLysArgMetGluValGlyGlnGlnAla

GTAGAAGTCTGGCAGGGCCTGGCCCTGCTGTCGGAAGCTGTCCTGCGGGGCCAGGCCCTG
181  ---------+---------+---------+---------+---------+---------+  240
     CATCTTCAGACCGTCCCGGACCGGGACGACAGCCTTCGACAGGACGCCCCGGTCCGGGAC
     ValGluValTrpGlnGlyLeuAlaLeuLeuSerGluAlaValLeuArgGlyGlnAlaLeu

TTGGTCAACTCTTCCCAGCCGTGGGAGCCCCTGCAGCTGCATGTGGATAAAGCCGTCAGT
241  ---------+---------+---------+---------+---------+---------+  300
     AACCAGTTGAGAAGGGTCGGCACCCTCGGGGACGTCGACGTACACCTATTTCGGCAGTCA
     LeuValAsnSerSerGlnProTrpGluProLeuGlnLeuHisValAspLysAlaValSer

GGCCTTCGCAGCCTCACCACTCTGCTTCGGGCTCTGGGAGCCCAGAAGGAAGCCATCTCC
301  ---------+---------+---------+---------+---------+---------+  360
     CCGGAAGCGTCGGAGTGGTGAGACGAAGCCCGAGACCCTCGGGTCTTCCTTCGGTAGAGG
     GlyLeuArgSerLeuThrThrLeuLeuArgAlaLeuGlyAlaGlnLysGluAlaIleSer

CCTCCAGATGCGGCCTCAGCTGCTCCACTCCGAACAATCACTGCTGACACTTTCCGCAAA
361  ---------+---------+---------+---------+---------+---------+  420
     GGAGGTCTACGCCGGAGTCGACGAGGTGAGGCTTGTTAGTGACGACTGTGAAAGGCGTTT
     ProProAspAlaAlaSerAlaAlaProLeuArgThrIleThrAlaAspThrPheArgLys

CTCTTCCGAGTCTACTCCAATTTCCTCCGGGGAAAGCTGAAGCTGTACACAGGGGAGGCC
421  ---------+---------+---------+---------+---------+---------+  480
     GAGAAGGCTCAGATGAGGTTAAAGGAGGCCCCTTTCGACTTCGACATGTGTCCCCTCCGG
     LeuPheArgValTyrSerAsnPheLeuArgGlyLysLeuLysLeuTyrThrGlyGluAla

TGCAGGACAGGGGACAGATGA
481  ---------+---------+-  501
     ACGTCCTGTCCCCTGTCTACT
     CysArgThrGlyAspArg                      Figure 6
```

```
        GAAGGGATCTGCAGGAATCGTGTGACTAATAATGTAAAAGACGTCACTAAATTGGTGGCA
  1     ---------+---------+---------+---------+---------+---------+  60
        CTTCCCTAGACGTCCTTAGCACACTGATTATTACATTTTCTGCAGTGATTTAACCACCGT

GluGlyIleCysArgAsnArgValThrAsnAsnValLysAspValThrLysLeuValAla

AATCTTCCAAAAGACTACATGATAACCCTCAAATATGTCCCCGGGATGGATGTTTTGCCA
  61    ---------+---------+---------+---------+---------+---------+ 120
        TTAGAAGGTTTTCTGATGTACTATTGGGAGTTTATACAGGGGCCCTACCTACAAAACGGT

AsnLeuProLysAspTyrMetIleThrLeuLysTyrValProGlyMetAspValLeuPro

AGTCATTGTTGGATAAGCGAGATGGTAGTACAATTGTCAGACAGCTTGACTGATCTTCTG
 121    ---------+---------+---------+---------+---------+---------+ 180
        TCAGTAACAACCTATTCGCTCTACCATCATGTTAACAGTCTGTCGAACTGACTAGAAGAC

SerHisCysTrpIleSerGluMetValValGlnLeuSerAspSerLeuThrAspLeuLeu

GACAAGTTTTCAAATATTTCTGAAGGCTTGAGTAATTATTCCATCATAGACAAACTTGTG
 181    ---------+---------+---------+---------+---------+---------+ 240
        CTGTTCAAAAGTTTATAAAGACTTCCGAACTCATTAATAAGGTAGTATCTGTTTGAACAC

AspLysPheSerAsnIleSerGluGlyLeuSerAsnTyrSerIleIleAspLysLeuVal

AATATAGTCGATGACCTTGTGGAGTGCGTCAAAGAAAACTCATCTAAGGATCTAAAAAAA
 241    ---------+---------+---------+---------+---------+---------+ 300
        TTATATCAGCTACTGGAACACCTCACGCAGTTTCTTTTGAGTAGATTCCTAGATTTTTTT

AsnIleValAspAspLeuValGluCysValLysGluAsnSerSerLysAspLeuLysLys

TCATTCAAGAGCCCAGAACCCAGGCTCTTTACTCCTGAAGAATTCTTTAGAATTTTTAAT
 301    ---------+---------+---------+---------+---------+---------+ 360
        AGTAAGTTCTCGGGTCTTGGGTCCGAGAAATGAGGACTTCTTAAGAAATCTTAAAAATTA

SerPheLysSerProGluProArgLeuPheThrProGluGluPhePheArgIlePheAsn

AGATCCATTGATGCCTTCAAGGACTTTGTAGTGGCATCTGAAACTAGTGATTGTGTGGTT
 361    ---------+---------+---------+---------+---------+---------+ 420
        TCTAGGTAACTACGGAAGTTCCTGAAACATCACCGTAGACTTTGATCACTAACACACCAA

ArgSerIleAspAlaPheLysAspPheValValAlaSerGluThrSerAspCysValVal

TCTTCAACATTAAGTCCTGAGAAAGATTCCAGAGTCAGTGTCACAAAACCATTTATGTTA
 421    ---------+---------+---------+---------+---------+---------+ 480
        AGAAGTTGTAATTCAGGACTCTTTCTAAGGTCTCAGTCACAGTGTTTTGGTAAATACAAT

SerSerThrLeuSerProGluLysAspSerArgValSerValThrLysProPheMetLeu
```

Figure 7a

```
        CCCCCTGTTGCAGCCAGCTCCCTTAGGAATGACAGCAGTAGCAGTAATAGGAAGGCCAAA
481     ---------+---------+---------+---------+---------+---------+ 540
        GGGGGACAACGTCGGTCGAGGGAATCCTTACTGTCGTCATCGTCATTATCCTTCCGGTTT

ProProValAlaAlaSerSerLeuArgAsnAspSerSerSerSerAsnArgLysAlaLys

AATCCCCCTGGAGACTCCAGCCTACACTGGGCAGCCATGGCATTGCCAGCATTGTTTTCT
541     ---------+---------+---------+---------+---------+---------+ 600
        TTAGGGGGACCTCTGAGGTCGGATGTGACCCGTCGGTACCGTAACGGTCGTAACAAAAGA

AsnProProGlyAspSerSerLeuHisTrpAlaAlaMetAlaLeuProAlaLeuPheSer

CTTATAATTGGCTTTGCTTTTGGAGCCTTATACTGGAAGAAGAGACAGCCAAGTCTTACA
601     ---------+---------+---------+---------+---------+---------+ 660
        GAATATTAACCGAAACGAAAACCTCGGAATATGACCTTCTTCTCTGTCGGTTCAGAATGT

LeuIleIleGlyPheAlaPheGlyAlaLeuTyrTrpLysLysArgGlnProSerLeuThr

AGGGCAGTTGAAAATATACAAATTAATGAAGAGGATAATGAGATAAGTATGTTGCAAGAG
661     ---------+---------+---------+---------+---------+---------+ 720
        TCCCGTCAACTTTTATATGTTTAATTACTTCTCCTATTACTCTATTCATACAACGTTCTC

ArgAlaValGluAsnIleGlnIleAsnGluGluAspAsnGluIleSerMetLeuGlnGlu

AAAGAGAGAGAGTTTCAAGAAGTGTAA
721     ---------+---------+------- 747
        TTTCTCTCTCTCAAAGTTCTTCACATT

LysGluArgGluPheGlnGluValEnd
```

Figure 7b

```
        GAAGGGATCTGCAGGAATCGTGTGACTAATAATGTAAAAGACGTCACTAAATTGGTGGCA
     1  ---------+---------+---------+---------+---------+---------+  60
        CTTCCCTAGACGTCCTTAGCACACTGATTATTACATTTTCTGCAGTGATTTAACCACCGT

GluGlyIleCysArgAsnArgValThrAsnAsnValLysAspValThrLysLeuValAla

AATCTTCCAAAAGACTACATGATAACCCTCAAATATGTCCCCGGGATGGATGTTTTGCCA
    61  ---------+---------+---------+---------+---------+---------+ 120
        TTAGAAGGTTTTCTGATGTACTATTGGGAGTTTATACAGGGGCCCTACCTACAAAACGGT

AsnLeuProLysAspTyrMetIleThrLeuLysTyrValProGlyMetAspValLeuPro

AGTCATTGTTGGATAAGCGAGATGGTAGTACAATTGTCAGACAGCTTGACTGATCTTCTG
   121  ---------+---------+---------+---------+---------+---------+ 180
        TCAGTAACAACCTATTCGCTCTACCATCATGTTAACAGTCTGTCGAACTGACTAGAAGAC

SerHisCysTrpIleSerGluMetValValGlnLeuSerAspSerLeuThrAspLeuLeu

GACAAGTTTTCAAATATTTCTGAAGGCTTGAGTAATTATTCCATCATAGACAAACTTGTG
   181  ---------+---------+---------+---------+---------+---------+ 240
        CTGTTCAAAAGTTTATAAAGACTTCCGAACTCATTAATAAGGTAGTATCTGTTTGAACAC

AspLysPheSerAsnIleSerGluGlyLeuSerAsnTyrSerIleIleAspLysLeuVal

AATATAGTCGATGACCTTGTGGAGTGCGTCAAAGAAAACTCATCTAAGGATCTAAAAAAA
   241  ---------+---------+---------+---------+---------+---------+ 300
        TTATATCAGCTACTGGAACACCTCACGCAGTTTCTTTTGAGTAGATTCCTAGATTTTTTT

AsnIleValAspAspLeuValGluCysValLysGluAsnSerSerLysAspLeuLysLys

TCATTCAAGAGCCCAGAACCCAGGCTCTTTACTCCTGAAGAATTCTTTAGAATTTTTAAT
   301  ---------+---------+---------+---------+---------+---------+ 360
        AGTAAGTTCTCGGGTCTTGGGTCCGAGAAATGAGGACTTCTTAAGAAATCTTAAAAATTA

SerPheLysSerProGluProArgLeuPheThrProGluGluPhePheArgIlePheAsn

AGATCCATTGATGCCTTCAAGGACTTTGTAGTGGCATCTGAAACTAGTGATTGTGTGGTT
   361  ---------+---------+---------+---------+---------+---------+ 420
        TCTAGGTAACTACGGAAGTTCCTGAAACATCACCGTAGACTTTGATCACTAACACACCAA

ArgSerIleAspAlaPheLysAspPheValValAlaSerGluThrSerAspCysValVal

TCTTCAACATTAAGTCCTGAGAAAGATTCCAGAGTCAGTGTCACAAAACCATTTATGTTA
   421  ---------+---------+---------+---------+---------+---------+ 480
        AGAAGTTGTAATTCAGGACTCTTTCTAAGGTCTCAGTCACAGTGTTTTGGTAAATACAAT

SerSerThrLeuSerProGluLysAspSerArgValSerValThrLysProPheMetLeu

CCCCCTGTTGCAGCC
   481  ---------+----- 495
        GGGGGACAACGTCGG

ProProValAlaAla
```

Figure 8

```
     ACCCAGGACTGCTCCTTCCAACACAGCCCCATCTCCTCCGACTTCGCTGTCAAAATCCGT
  1  ------------+---------+---------+---------+---------+---------+  60
     TGGGTCCTGACGAGGAAGGTTGTGTCGGGGTAGAGGAGGCTGAAGCGACAGTTTTAGGCA

ThrGlnAspCysSerPheGlnHisSerProIleSerSerAspPheAlaValLysIleArg

GAGCTGTCTGACTACCTGCTTCAAGATTACCCAGTCACCGTGGCCTCCAACCTGCAGGAC
 61  ---------+---------+---------+---------+---------+---------+ 120
     CTCGACAGACTGATGGACGAAGTTCTAATGGGTCAGTGGCACCGGAGGTTGGACGTCCTG

GluLeuSerAspTyrLeuLeuGlnAspTyrProValThrValAlaSerAsnLeuGlnAsp

GAGGAGCTCTGCGGGGGCCTCTGGCGGCTGGTCCTGGCACAGCGCTGGATGGAGCGGCTC
121  ---------+---------+---------+---------+---------+---------+ 180
     CTCCTCGAGACGCCCCCGGAGACCGCCGACCAGGACCGTGTCGCGACCTACCTCGCCGAG

GluGluLeuCysGlyGlyLeuTrpArgLeuValLeuAlaGlnArgTrpMetGluArgLeu

AAGACTGTCGCTGGGTCCAAGATGCAAGGCTTGCTGGAGCGCGTGAACACGGAGATACAC
181  ---------+---------+---------+---------+---------+---------+ 240
     TTCTGACAGCGACCCAGGTTCTACGTTCCGAACGACCTCGCGCACTTGTGCCTCTATGTG

LysThrValAlaGlySerLysMetGlnGlyLeuLeuGluArgValAsnThrGluIleHis

TTTGTCACCAAATGTGCCTTTCAGCCCCCCCCCAGCTGTCTTCGCTTCGTCCAGACCAAC
241  ---------+---------+---------+---------+---------+---------+ 300
     AAACAGTGGTTTACACGGAAAGTCGGGGGGGGGTCGACAGAAGCGAAGCAGGTCTGGTTG

PheValThrLysCysAlaPheGlnProProProSerCysLeuArgPheValGlnThrAsn

ATCTCCCGCCTCCTGCAGGAGACCTCCGAGCAGCTGGTGGCGCTGAAGCCCTGGATCACT
301  ---------+---------+---------+---------+---------+---------+ 360
     TAGAGGGCGGAGGACGTCCTCTGGAGGCTCGTCGACCACCGCGACTTCGGGACCTAGTGA

IleSerArgLeuLeuGlnGluThrSerGluGlnLeuValAlaLeuLysProTrpIleThr

CGCCAGAACTTCTCCCGGTGCCTGGAGCTGCAGTGTCAGCCCGACTCCTCAACCCTGCCA
361  ---------+---------+---------+---------+---------+---------+ 420
     GCGGTCTTGAAGAGGGCCACGGACCTCGACGTCACAGTCGGGCTGAGGAGTTGGGACGGT

ArgGlnAsnPheSerArgCysLeuGluLeuGlnCysGlnProAspSerSerThrLeuPro

CCCCCATGGAGTCCCCGGCCCTGGAGGCCACAGCCCCGACAGCCCCGCAGCCCCCTCTG
421  ---------+---------+---------+---------+---------+---------+ 480
     GGGGGTACCTCAGGGGCCGGGGACCTCCGGTGTCGGGGCTGTCGGGGCGTCGGGGGAGAC

ProProTrpSerProArgProLeuGluAlaThrAlaProThrAlaProGlnProProLeu
```

Figure 9a

```
        CTCCTCCTACTGCTGCTGCCCGTGGGCCTCCTGCTGCTGGCCGCTGCCTGGTGCCTGCAC
481     ---------+---------+---------+---------+---------+---------+ 540
        GAGGAGGATGACGACGACGGGCACCCGGAGGACGACGACCGGCGACGGACCACGGACGTG

LeuLeuLeuLeuLeuLeuProValGlyLeuLeuLeuLeuAlaAlaAlaTrpCysLeuHis

TGGCAGAGGACGCGGCGGAGGACACCCCGCCCTGGGGAGCAGGTGCCCCCCGTCCCCAGT
541     ---------+---------+---------+---------+---------+---------+ 600
        ACCGTCTCCTGCGCCGCCTCCTGTGGGGCGGGACCCCTCGTCCACGGGGGGCAGGGGTCA

TrpGlnArgThrArgArgArgThrProArgProGlyGluGlnValProProValProSer

CCCCAGGACCTGCTGCTTGTGGAGCACTGA
601     ---------+---------+---------+ 630
        GGGGTCCTGGACGACGAACACCTCGTGACT

ProGlnAspLeuLeuLeuValGluHisEnd
```

Figure 9b

```
    ACCCAGGACTGCTCCTTCCAACACAGCCCCATCTCCTCCGACTTCGCTGTCAAAATCCGT
  1 ---------+---------+---------+---------+---------+---------+ 60
    TGGGTCCTGACGAGGAAGGTTGTGTCGGGGTAGAGGAGGCTGAAGCGACAGTTTTAGGCA

ThrGlnAspCysSerPheGlnHisSerProIleSerSerAspPheAlaValLysIleArg

GAGCTGTCTGACTACCTGCTTCAAGATTACCCAGTCACCGTGGCCTCCAACCTGCAGGAC
 61 ---------+---------+---------+---------+---------+---------+ 120
    CTCGACAGACTGATGGACGAAGTTCTAATGGGTCAGTGGCACCGGAGGTTGGACGTCCTG

GluLeuSerAspTyrLeuLeuGlnAspTyrProValThrValAlaSerAsnLeuGlnAsp

GAGGAGCTCTGCGGGGGCCTCTGGCGGCTGGTCCTGGCACAGCGCTGGATGGAGCGGCTC
121 ---------+---------+---------+---------+---------+---------+ 180
    CTCCTCGAGACGCCCCCGGAGACCGCCGACCAGGACCGTGTCGCGACCTACCTCGCCGAG

GluGluLeuCysGlyGlyLeuTrpArgLeuValLeuAlaGlnArgTrpMetGluArgLeu

AAGACTGTCGCTGGGTCCAAGATGCAAGGCTTGCTGGAGCGCGTGAACACGGAGATACAC
181 ---------+---------+---------+---------+---------+---------+ 240
    TTCTGACAGCGACCCAGGTTCTACGTTCCGAACGACCTCGCGCACTTGTGCCTCTATGTG

LysThrValAlaGlySerLysMetGlnGlyLeuLeuGluArgValAsnThrGluIleHis

TTTGTCACCAAATGTGCCTTTCAGCCCCCCCCCAGCTGTCTTCGCTTCGTCCAGACCAAC
241 ---------+---------+---------+---------+---------+---------+ 300
    AAACAGTGGTTTACACGGAAAGTCGGGGGGGGGTCGACAGAAGCGAAGCAGGTCTGGTTG

PheValThrLysCysAlaPheGlnProProProSerCysLeuArgPheValGlnThrAsn

ATCTCCCGCCTCCTGCAGGAGACCTCCGAGCAGCTGGTGGCGCTGAAGCCCTGGATCACT
301 ---------+---------+---------+---------+---------+---------+ 360
    TAGAGGGCGGAGGACGTCCTCTGGAGGCTCGTCGACCACCGCGACTTCGGGACCTAGTGA

IleSerArgLeuLeuGlnGluThrSerGluGlnLeuValAlaLeuLysProTrpIleThr

CGCCAGAACTTCTCCCGGTGCCTGGAGCTGCAGTGTCAGCCC
361 ---------+---------+---------+---------+-- 402
    GCGGTCTTGAAGAGGGCCACGGACCTCGACGTCACAGTCGGG

ArgGlnAsnPheSerArgCysLeuGluLeuGlnCysGlnPro
```

MULTI-FUNCTIONAL CHIMERIC HEMATOPOIETIC RECEPTOR AGONISTS

The present application claims priority under Title 35, United States Code, §119 of U.S. Provisional application Ser. No. 60/029,629, filed Oct. 25, 1996.

FIELD OF THE INVENTION

The present invention relates to multi-functional chimeric hematopoietic receptor agonists. These multi-functional chimeric hematopoietic receptor agonists retain one or more activities of individual components of the chimera molecule and may also show improved hematopoietic cell-stimulating activity and/or an improved activity profile which may include reduction of undesirable biological activities associated with individual hematopoietic growth factors and/or have improved physical properties which may include increased solubility, stability and refold efficiency.

BACKGROUND OF THE INVENTION

Colony stimulating factors (CSFs) which stimulate the differentiation and/or proliferation of bone marrow cells have generated much interest because of their therapeutic potential for restoring depressed levels of hematopoietic stem cell-derived cells. CSFs in both human and murine systems have been identified and distinguished according to their activities. For example, granulocyte-CSF (G-CSF) and macrophage-CSF (M-CSF) stimulate the in vitro formation of neutrophilic granulocyte and macrophage colonies, respectively, while GM-CSF and interleukin-3 (IL-3) have broader activities and stimulate the formation of both macrophage, neutrophilic and eosinophilic granulocyte colonies. IL-3 also stimulates the formation of mast, megakaryocyte and pure and mixed erythroid colonies.

U.S. Pat. No. 4,877,729 and U.S. Pat. No. 4,959,455 disclose a gibbon IL-3 cDNA and a deduced human IL-3 DNA sequence and the protein sequences for which they code. The hIL-3 disclosed has serine rather than proline at position 8 in the protein sequence.

International Patent Application (PCT) WO 88/00598 discloses gibbon- and human-like IL-3. The hIL-3 contains a $Ser^8$->$Pro^8$ replacement. Suggestions are made to replace Cys by Ser, thereby breaking the disulfide bridge, and to replace one or more amino acids at the glycosylation sites.

U.S. Pat. No. 4,810,643 discloses a DNA sequence encoding human G-CSF.

WO 91/02754 discloses a fusion protein comprised of GM-CSF and IL-3 which has increased biological activity compared to GM-CSF or IL-3 alone. Also disclosed are nonglycosylated IL-3 and GM-CSF analog proteins as components of the multi-functional chimeric hematopoietic receptor agonist.

WO 92/04455 discloses fusion proteins composed of IL-3 fused to a lymphokine selected from the group consisting of IL-3, IL-6, IL-7, IL-9, IL-11, EPO and G-CSF.

WO 95/21197 and WO 95/21254 disclose fusion proteins capable of broad multi-functional hematopoietic properties.

GB 2,285,446 relates to the c-mpl ligand (thrombopoietin) and various forms of thrombopoietin which are shown to influence the replication, differentiation and maturation of megakaryocytes and megakaryocytes progenitors which may be used for the treatment of thrombocytopenia.

EP 675,201 A1 relates to the c-mpl ligand (Megakaryocyte growth and development factor (MGDF), allelic variations of c-mpl ligand and c-mpl ligand attached to water soluble polymers such as polyethylene glycol.

WO 95/21920 provides the murine and human c-mpl ligand and polypeptide fragments thereof. The proteins are useful for in vivo and ex vivo therapy for stimulating platelet production.

U.S. Pat. No. 4,703,008 by Lin, F-K. discloses the a cDNA sequence encoding erythropoietin, methods of production and uses for erythropoietin.

WO 91/05867 discloses analogs of human erythropoietin having a greater number of sites for carbohydrate attachment than human erythropoietin, such as EPO ($Asn^{69}$) EPO ($Asn^{125}$, $Ser^{127}$), EPO ($Thr^{125}$) and EPO ($Pro^{124}$, $Thr^{125}$).

WO 94/24160 discloses erythropoietin muteins which have enhanced activity, specifically amino acid substitutions at positions 20, 49, 73, 140, 143, 146, 147 and 154.

WO 94/28391 discloses the native flt3 ligand protein sequence and a cDNA sequence encoding the flt3 ligand, methods of expressing flt3 ligand in a host cell transfected with the cDNA and methods of treating patients with a hematopoietic disorder using flt3 ligand.

U.S. Pat. No. 5,554,512 is directed to human flt3 ligand as an isolated protein, DNA encoding the flt3 ligand, host cells transfected with cDNAs encoding flt3 ligand and methods for treating patients with flt3 ligand.

WO 94/26891 provides mammalianflt3 ligands, including an isolate that has an insertion of 29 amino acids, and fragments there of.

Rearrangement of Protein Sequences

In evolution, rearrangements of DNA sequences serve an important role in generating a diversity of protein structure and function. Gene duplication and exon shuffling provide an important mechanism to rapidly generate diversity and thereby provide organisms with a competitive advantage, especially since the basal mutation rate is low (Doolittle, *Protein Science* 1:191–200, 1992).

The development of recombinant DNA methods has made it possible to study the effects of sequence transposition on protein folding, structure and function. The approach used in creating new sequences resembles that of naturally occurring pairs of proteins that are related by linear reorganization of their amino acid sequences (Cunningham, et al., *Proc. Natl. Acad. Sci. U.S.A.* 76:3218–3222, 1979; Teather & Erfle,*J. Bacteriol.* 172: 3837–3841, 1990; Schimming et al., *Eur. J. Biochem.* 204: 13–19, 1992; Yamiuchi and Minamikawa, *FEBS Lett.* 260:127–130, 1991; MacGregor et al., *FEBS Lett.* 378:263–266). The first in vitro application of this type of rearrangement to proteins was described by Goldenberg and Creighton (*J. Mol. Biol.* 165:407–413, 1983). A new N-terminus is selected at an internal site (breakpoint) of the original sequence, the new sequence having the same order of amino acids as the original from the breakpoint until it reaches an amino acid that is at or near the original C-terminus. At this point the new sequence is joined, either directly or through an additional portion of sequence (linker), to an amino acid that is at or near the original N-terminus, and the new sequence continues with the same sequence as the original until it reaches a point that is at or near the amino acid that was N-terminal to the breakpoint site of the original sequence, this residue forming the new C-terminus of the chain.

This approach has been applied to proteins which range in size from 58 to 462 amino acids (Goldenberg & Creighton, *J. Mol. Biol.* 165:407–413, 1983; Li & Coffino, *Mol. Cell. Biol.* 13:2377–2383, 1993). The proteins examined have represented a broad range of structural classes, including proteins that contain predominantly a-helix (interleukin-4; Kreitman et al., *Cytokine* 7:311–318, 1995), b-sheet (interleukin-1; Horlick et al., *Protein Eng.* 5:427–431, 1992), or mixtures of the two (yeast phosphoribosyl anthranilate isomerase; Luger et al., *Science* 243:206–210, 1989). Broad categories of protein function are represented in these sequence reorganization studies:

| Enzymes | |
|---|---|
| T4 lysozyme | Zhang et al., Biochemistry 32:12311–12318, 1993; Zhang et al., Nature Struct. Biol. 1:434–438 (1995) |
| dihydrofolate reductase | Buchwalder et al., Biochemistry 31:1621–1630, 1994; Protasova et al., Prot. Eng. 7:1373–1377, 1995) |
| ribonuclease T1 | Mullins et al., J. Am. Chem. Soc. 116:5529–5533, 1994; Garrett et al., Protein Science 5:204–211, 1996) |
| Bacillus b-glucanse | Hahn et al., Proc. Natl. Acad. Sci. U.S.A. 91:10417–10421, 1994) |
| aspartate transcarbamoylase | Yang & Schachman, Proc. Natl. Acad. Sci. U.S.A. 90:11980–11984, 1993) |
| phosphoribosyl anthranilate isomerase | Luger et al., Science 243:206–210 (1989; Luger et al., Prot. Eng. 3:249–258, 1990) |
| pepsin/pepsinogen | Lin et al., Protein Science 4:159–166, 1995) |
| glyceraldehyde-3-phosphate dehydrogenase | Vignais et al., Protein Science 4:994–1000, 1995) |
| ornithine decarboxylase | Li & Coffino, Mol. Cell. Biol. 13:2377–2383, 1993) |
| yeast phosphoglycerate dehydrogenase | Ritco-Vonsovici et al., Biochemistry 34:16543–16551, 1995) |
| Enzyme Inhibitor | |
| basic pancreatic trypsin inhibitor | Goldenberg & Creighton, J. Mol. Biol. 165:407–413, 1983) |
| Cytokines | |
| interleukin-1b | Horlick et al., Protein Eng. 5:427–431, 1992) |
| interleukin-4 | Kreitman et al., Cytokine 7:311–318, 1995) |
| Tyrosine Kinase Recognition Domain | |
| a-spectrin SH3 domain | Viguera, et al., J. Mol. Biol. 247:670–681, 1995) |
| Transmembrane Protein | |
| omp A | Koebnik & Kramer, J. Mol. Biol. 250:617–626, 1995) |
| Chimeric Protein | |
| interleukin-4-Pseudomonas exotoxin | Kreitman et al., Proc. Natl. Acad. Sci. U.S.A. 91:6889–6893, 1994). |

The results of these studies have been highly variable. In many cases substantially lower activity, solubility or thermodynamic stability were observed (*E. coli* dihydrofolate reductase, aspartate transcarbamoylase, phosphoribosyl anthranilate isomerase, glyceraldehyde-3-phosphate dehydrogenase, ornithine decarboxylase, omp A, yeast phosphoglycerate dehydrogenase). In other cases, the sequence rearranged protein appeared to have many nearly identical properties as its natural counterpart (basic pancreatic trypsin inhibitor, T4 lysozyme, ribonuclease T1, *Bacillus* b-glucanase, interleukin-1b, a-spectrin SH3 domain, pepsinogen, interleukin-4). In exceptional cases, an unexpected improvement over some properties of the natural sequence was observed, e.g., the solubility and refolding rate for rearranged a-spectrin SH3 domain sequences, and the receptor affinity and anti-tumor activity of transposed interleukin-4-*Pseudomonas* exotoxin fusion molecule (Kreitman et al., *Proc. Natl. Acad. Sci. U.S.A.* 91:6889–6893, 1994; Kreitman et al., *Cancer Res.* 55:3357–3363, 1995).

The primary motivation for these types of studies has been to study the role of short-range and long-range interactions in protein folding and stability. Sequence rearrangements of this type convert a subset of interactions that are long-range in the original sequence into short-range interactions in the new sequence, and vice versa. The fact that many of these sequence rearrangements are able to attain a conformation with at least some activity is persuasive evidence that protein folding occurs by multiple folding pathways (Viguera, et al., *J. Mol. Biol.* 247:670–681, 1995). In the case of the SH3 domain of a-spectrin, choosing new termini at locations that corresponded to b-hairpin turns resulted in proteins with slightly less stability, but which were nevertheless able to fold.

The positions of the internal breakpoints used in the studies cited here are found exclusively on the surface of proteins, and are distributed throughout the linear sequence without any obvious bias towards the ends or the middle (the variation in the relative distance from the original N-terminus to the breakpoint is ca. 10 to 80% of the total sequence length). The linkers connecting the original N- and C-termini in these studies have ranged from 0 to 9 residues. In one case (Yang & Schachman, *Proc. Natl. Acad. Sci. U.S.A.* 90:11980–11984, 1993), a portion of sequence has been deleted from the original C-terminal segment, and the connection made from the truncated C-terminus to the original N-terminus. Flexible hydrophilic residues such as Gly and Ser are frequently used in the linkers. Viguera, et al. (*J. Mol. Biol.* 247:670–681, 1995) compared joining the original N- and C-termini with 3- or 4-residue linkers; the 3-residue linker was less thermodynamically stable. Protasova et al. (*Protein Eng.* 7:1373–1377, 1994) used 3- or 5-residue linkers in connecting the original N-termini of *E. coli* dihydrofolate reductase; only the 3-residue linker produced protein in good yield.

SUMMARY OF THE INVENTION

A hematopoietic protein comprising; an amino acid sequence of the formula:

$$R_1\text{-}L_1\text{-}R_2, \ R_2\text{-}L_1\text{-}R_1, \ R_1\text{-}R_2 \ \text{or} \ R_2\text{-}R_1$$

wherein $R_1$ and $R_2$ are independently selected from the group consisting of;

(I) A human EPO receptor agonist polypeptide, comprising a modified EPO amino acid sequence of the Formula:

```
AlaProProArgLeuIleCysAspSerArgValLeuGluArgTyrLeuLeuGluAlaLys
                10                                        20

GluAlaGluAsnIleThrThrGlyCysAlaGluHisCysSerLeuAsnGluAsnIleThr
                30                                        40

ValProAspThrLysValAsnPheTyrAlaTrpLysArgMetGluValGlyGlnGlnAla
                50                                        60

ValGluValTrpGlnGlyLeuAlaLeuLeuSerGluAlaValLeuArgGlyGlnAlaLeu
                70                                        80

LeuValAsnSerSerGlnProTrpGluProLeuGlnLeuHisValAspLysAlaValSer
                90                                       100

GlyLeuArgSerLeuThrThrLeuLeuArgAlaLeuGlyAlaGlnLysGluAlaIleSer
               110                                       120

ProProAspAlaAlaSerAlaAlaProLeuArgThrIleThrAlaAspThrPheArgLys
               130                                       140

LeuPheArgValTyrSerAsnPheLeuArgGlyLysLeuLysLeuTyrThrGlyGluAla
               150                                       160

CysArgThrGlyAspArg
        166
``` wherein optionally 1–6 amino acids from the N-terminus and 1–5 from the C-terminus can be deleted from said EPO receptor agonist polypeptide;

wherein the N-terminus is joined to the C-terminus directly or through a linker ($L_2$) capable of joining the N-terminus to the C-terminus and having new C- and N-termini at amino acids;

| | | |
|---|---|---|
| 23–24 | 47–48 | 109–110 |
| 24–25 | 48–49 | 110–111 |
| 25–26 | 49–50 | 111–112 |
| 26–27 | 50–51 | 112–113 |
| 27–28 | 51–52 | 113–114 |
| 28–29 | 52–53 | 114–115 |
| 29–30 | 53–54 | 115–116 |
| 30–31 | 54–55 | 116–117 |
| 31–32 | 55–56 | 117–118 |
| 32–33 | 56–57 | 118–119 |
| 33–34 | 57–58 | 119–120 |
| 34–35 | 77–78 | 120–121 |
| 35–36 | 78–79 | 121–122 |
| 36–37 | 79–80 | 122–123 |
| 37–38 | 80–81 | 123–124 |
| 38–39 | 81–82 | 124–125 |
| 39–40 | 82–83 | 125–126 |
| 40–41 | 84–85 | 126–127 |
| 41–42 | 85–86 | 127–128 |
| 42–43 | 86–87 | 128–129 |
| 43–44 | 87–88 | 129–130 |
| 44–45 | 88–89 | 130–131 |
| 45–46 | 108–109 | 131–132 |
| 46–47 | | respectively; and |

(II) A human stem cell factor receptor agonist polypeptide, comprising a modified stem cell factor amino acid sequence of the Formula:

```
GluGlyIleCysArgAsnArgValThrAsnAsnValLysAspValThrLysLeuValAla   SEQ ID NO:465
                10                                        20

AsnLeuProLysAspTyrMetIleThrLeuLysTyrValProGlyMetAspValLeuPro
                30                                        40

SerHisCysTrpIleSerGluMetValValGlnLeuSerAspSerLeuThrAspLeuLeu
                50                                        60

AspLysPheSerAsnIleSerGluGlyLeuSerAsnTyrSerIleIleAspLysLeuVal
                70                                        80

AsnIleValAspAspLeuValGluCysValLysGluAsnSerSerLysAspLeuLysLys
                90                                       100

SerPheLysSerProGluProArgLeuPheThrProGluGluPhePheArgIlePheAsn
               110                                       120

ArgSerIleAspAlaPheLysAspPheValValAlaSerGluThrSerAspCysValVal
               130                                       140
```

-continued
```
SerSerThrLeuSerProGluLysAspSerArgValSerValThrLysProPheMetLeu
            150                                   160

ProProValAlaAla
          165
``` wherein optionally 1–23 amino acids can be deleted from the C-terminus of said stem cell factor receptor agonist polypeptide;

wherein the N-terminus is joined to the C-terminus directly or through a linker (L$_2$) capable of joining the N-terminus to the C-terminus and having new C- and N-termini at amino acids;

| | | |
|---|---|---|
| 23–24 | 39–40 | 96–97 |
| 24–25 | 40–41 | 97–98 |
| 25–26 | 64–65 | 98–99 |
| 26–27 | 65–66 | 99–100 |
| 27–28 | 66–67 | 100–101 |
| 28–29 | 67–68 | 101–102 |
| 29–30 | 68–69 | 102–103 |
| 30–31 | 69–70 | 103–104 |
| 31–32 | 70–71 | 104–105 |
| 32–33 | 89–90 | 105–106 |
| 33–34 | 90–91 | 106–107 |
| 34–35 | 91–92 | 107–108 |
| 35–36 | 92–93 | 108–109 |
| 36–37 | 93–94 | 109–110 |
| 37–38 | 94–95 | 110–111 |
| 38–39 | 95–96 | respectively; and |

(III) A human flt-3 receptor agonist polypeptide, comprising a modified flt-3 ligand amino acid sequence of the Formula:

```
ThrGlnAspCysSerPheGlnHisSerProIleSerSerAspPheAlaValLysIleArg  SEQ ID NO:466
                  10                                  20

GluLeuSerAspTyrLeuLeuGlnAspTyrProValThrValAlaSerAsnLeuGlnAsp
                  30                                  40

GluGluLeuCysGlyGlyLeuTrpArgLeuValLeuAlaGlnArgTrpMetGluArgLeu
                  50                                  60

LysThrValAlaGlySerLysMetGlnGlyLeuLeuGluArgValAsnThrGluIleHis
                  70                                  80

PheValThrLysCysAlaPheGlnProProProSerCysLeuArgPheValGlnThrAsn
                  90                                 100

IleSerArgLeuLeuGlnGluThrSerGluGlnLeuValAlaLeuLysProTrpIleThr
                 110                                 120

ArgGlnAsnPheSerArgCysLeuGluLeuGlnCysGlnProAspSerSerThrLeu
                 130
``` wherein 1–7 amino acids are optionally deleted from the C-terminus of said flt-3 receptor agonist polypeptide;

wherein the N-terminus is joined to the C-terminus directly or through a linker (L$_2$) capable of joining the N-terminus to the C-terminus and having new C- and N-termini at amino acids;

| | | |
|---|---|---|
| 28–29 | 42–43 | 93–94 |
| 29–30 | 64–65 | 94–95 |
| 30–31 | 65–66 | 95–96 |
| 31–32 | 66–67 | 96–97 |
| 32–33 | 86–87 | 97–98 |
| 34–35 | 87–88 | 98–99 |
| 36–37 | 88–89 | 99–100 |
| 37–38 | 89–90 | 100–101 |
| 38–39 | 90–91 | 101–102 |
| 39–40 | 91–92 | 102–103 |
| 40–41 | 92–93 | respectively; and |
| 41–42 | | |

(IV) A polypeptide comprising; a modified human G-CSF amino acid sequence of the formula:

```
1                              10                    SEQ ID NO:858
Xaa Xaa Xaa Gly Pro Ala Ser Ser Leu Pro Gln Ser Xaa

20
Leu Leu Xaa Xaa Xaa Glu Gln Val Xaa Lys Xaa Gln Gly Xaa Gly 30                                 40
Ala Xaa Leu Gln Glu Xaa Leu Xaa Ala Thr Tyr Lys Leu Xaa Xaa

50
Xaa Glu Xaa Xaa Val Xaa Xaa Gly His Ser Xaa Gly Ile Pro Trp 60                                              70
Ala Pro Leu Ser Ser Xaa Pro Ser Xaa Ala Leu Xaa Leu Ala Gly

80
Xaa Leu Ser Gln Leu His Ser Gly Leu Phe Leu Tyr Gln Gly Leu 90                                     100
Leu Gln Ala Leu Glu Gly Ile Ser Pro Glu Leu Gly Pro Thr Leu

110
Xaa Thr Leu Gln Xaa Asp Val Ala Asp Phe Ala Xaa Thr Ile Trp 120                                    130
Gln Gln Met Glu Xaa Xaa Gly Met Ala Pro Ala Leu Gln Pro Thr

140
Gln Gly Ala Met Pro Ala Phe Ala Ser Ala Xaa Gln Xaa Xaa Ala 150                                    160
Gly Gly Val Leu Val Ala Ser Xaa Leu Gln Xaa Phe Leu Xaa Xaa

170
Ser Tyr Arg Val Leu Xaa Xaa Leu Ala Gln Pro
``` wherein
Xaa at position 1 is Thr, Ser, Arg, Tyr or Gly;
Xaa at position 2 is Pro or Leu;
Xaa at position 3 is Leu, Arg, Tyr or Ser;
Xaa at position 13 is Phe, Ser, His, Thr or Pro;
Xaa at position 16 is Lys, Pro, Ser, Thr or His;
Xaa at position 17 is Cys, Ser, Gly, Ala, Ile, Tyr or Arg;
Xaa at position 18 is Leu, Thr, Pro, His, Ile or Cys;
Xaa at position 22 is Arg, Tyr, Ser, Thr or Ala;
Xaa at position 24 is Ile, Pro, Tyr or Leu;
Xaa at position 27 is Asp, or Gly;
Xaa at position 30 is Ala, Ile, Leu or Gly;
Xaa at position 34 is Lys or Ser;
Xaa at position 36 is Cys or Ser;
Xaa at position 42 is Cys or Ser;
Xaa at position 43 is His, Thr, Gly, Val, Lys, Trp, Ala, Arg, Cys, or Leu;
Xaa at position 44 is Pro, Gly, Arg, Asp, Val, Ala, His, Trp, Gln, or Thr;
Xaa at position 46 is Glu, Arg, Phe, Arg, Ile or Ala;
Xaa at position 47 is Leu or Thr;
Xaa at position 49 is Leu, Phe, Arg or Ser;
Xaa at position 50 is Leu, Ile, His, Pro or Tyr;
Xaa at position 54 is Leu or His;
Xaa at position 64 is Cys or Ser;
Xaa at position 67 is Gln, Lys, Leu or Cys;
Xaa at position 70 is Gln, Pro, Leu, Arg or Ser;
Xaa at position 74 is Cys or Ser;
Xaa at position 104 is Asp, Gly or Val;
Xaa at position 108 is Leu, Ala, Val, Arg, Trp, Gln or Gly;
Xaa at position 115 is Thr, His, Leu or Ala;
Xaa at position 120 is Gln, Gly, Arg, Lys or His
Xaa at position 123 is Glu, Arg, Phe or Thr
Xaa at position 144 is Phe, His, Arg, Pro, Leu, Gln or Glu;
Xaa at position 146 is Arg or Gln;
Xaa at position 147 is Arg or Gln;
Xaa at position 156 is His, Gly or Ser;
Xaa at position 159 is Ser, Arg, Thr, Tyr, Val or Gly;
Xaa at position 162 is Glu, Leu, Gly or Trp;
Xaa at position 163 is Val, Gly, Arg or Ala;
Xaa at position 169 is Arg, Ser, Leu, Arg or Cys;
Xaa at position 170 is His, Arg or Ser;
wherein optionally 1–11 amino acids from the N-terminus and 1–5 from the C-terminus can optionally be deleted from said modified human G-CSF amino acid sequence; and wherein the N-terminus is joined to the C-terminus directly or through a linker ($L_2$) capable of joining the N-terminus to the C-terminus and having new C- and N-termini at amino acids;

| | | |
|---|---|---|
| 38–39 | 62–63 | 123–124 |
| 39–40 | 63–64 | 124–125 |
| 40–41 | 64–65 | 125–126 |
| 41–42 | 65–66 | 126–127 |
| 42–43 | 66–67 | 128–129 |
| 43–44 | 67–68 | 128–129 |
| 45–46 | 68–69 | 129–130 |
| 48–49 | 69–70 | 130–131 |
| 49–50 | 70–71 | 131–132 |
| 52–53 | 71–72 | 132–133 |
| 53–54 | 91–92 | 133–134 |
| 54–55 | 92–93 | 134–135 |
| 55–56 | 93–94 | 135–136 |
| 56–57 | 94–95 | 136–137 |
| 57–58 | 95–96 | 137–138 |
| 58–59 | 96–97 | 138–139 |
| 59–60 | 97–98 | 139–140 |
| 60–61 | 98–99 | 140–141 |
| 61–62 | 99–100 | 141–142 |
| | | or 142–143 |
| | | respectively; |

(V) A polypeptide comprising; a modified human IL-3 amino acid sequence of the formula:

```
Ala Pro Met Thr Gln Thr Thr Ser Leu Lys Thr Ser Trp Val Asn    SEQ ID NO:859
1               5                   10                  15

Cys Xaa Xaa Xaa Xaa Xaa Xaa Xaa Xaa Xaa Xaa Xaa Xaa Xaa Xaa
                20                  25                  30

Xaa Xaa Xaa Xaa Xaa Xaa Xaa Xaa Asn Xaa Xaa Xaa Xaa Xaa Xaa
                35                  40                  45

Xaa Xaa Xaa Xaa Xaa Xaa Xaa Xaa Xaa Xaa Xaa Xaa Xaa Xaa Xaa
                50                  55                  60

Xaa Xaa Xaa Xaa Xaa Xaa Xaa Xaa Xaa Xaa Xaa Xaa Xaa Xaa Xaa
                65                  70                  75

Xaa Xaa Xaa Xaa Xaa Xaa Xaa Xaa Xaa Xaa Xaa Xaa Xaa Xaa Xaa
                80                  85                  90

Xaa Xaa Xaa Xaa Xaa Xaa Xaa Xaa Xaa Xaa Xaa Xaa Xaa Xaa Xaa
                95                  100                 105

Xaa Phe Xaa Xaa Xaa Xaa Xaa Xaa Xaa Xaa Xaa Xaa Xaa Xaa Xaa
                110                 115                 120

Xaa Xaa Xaa Gln Gln Thr Thr Leu Ser Leu Ala Ile Phe
                125                 130
``` wherein Xaa at position 17 is Ser, Lys, Gly, Asp, Met, Gln, or Arg;

Xaa at position 18 is Asn, His, Leu, Ile, Phe, Arg, or Gln;

Xaa at position 19 is Met, Phe, Ile, Arg, Gly, Ala, or Cys;

Xaa at position 20 is Ile, Cys, Gln, Glu, Arg, Pro, or Ala;

Xaa at position 21 is Asp, Phe, Lys, Arg, Ala, Gly, Glu, Gln, Asn, Thr, Ser or Val;

Xaa at position 22 is Glu, Trp, Pro, Ser, Ala, His, Asp, Asn, Gln, Leu, Val or Gly;

Xaa at position 23 is Ile, Val, Ala, Gly, Trp, Lys, Phe, Leu, Ser, or Arg;

Xaa at position 24 is Ile, Gly, Val, Arg, Ser, Phe, or Leu;

Xaa at position 25 is Thr, His, Gly, Gln, Arg, Pro, or Ala;

Xaa at position 26 is His, Thr, Phe, Gly, Arg, Ala, or Trp;

Xaa at position 27 is Leu, Gly, Arg, Thr, Ser, or Ala;

Xaa at position 28 is Lys, Arg, Leu, Gln, Gly, Pro, Val or Trp;

Xaa at position 29 is Gln, Asn, Leu, Pro, Arg, or Val;

Xaa at position 30 is Pro, His, Thr, Gly, Asp, Gln, Ser, Leu, or Lys;

Xaa at position 31 is Pro, Asp, Gly, Ala, Arg, Leu, or Gln;

Xaa at position 32 is Leu, Val, Arg, Gln, Asn, Gly, Ala, or Glu;

Xaa at position 33 is Pro, Leu, Gln, Ala, Thr, or Glu;

Xaa at position 34 is Leu, Val, Gly, Ser, Lys, Glu, Gln, Thr, Arg, Ala, Phe, Ile or Met;

Xaa at position 35 is Leu, Ala, Gly, Asn, Pro, Gln, or Val;

Xaa at position 36 is Asp, Leu, or Val;

Xaa at position 37 is Phe, Ser, Pro, Trp, or Ile;

Xaa at position 38 is Asn, or Ala;

Xaa at position 40 is Leu, Trp, or Arg;

Xaa at position 41 is Asn, Cys, Arg, Leu, His, Met, or Pro;

Xaa at position 42 is Gly, Asp, Ser, Cys, Asn, Lys, Thr, Leu, Val, Glu, Phe, Tyr, Ile, Met or Ala;

Xaa at position 43 is Glu, Asn, Tyr, Leu, Phe, Asp, Ala, Cys, Gln, Arg, Thr, Gly or Ser;

Xaa at position 44 is Asp, Ser, Leu, Arg, Lys, Thr, Met, Trp, Glu, Asn, Gln, Ala or Pro;

Xaa at position 45 is Gln, Pro, Phe, Val, Met, Leu, Thr, Lys, Trp, Asp, Asn, Arg, Ser, Ala, Ile, Glu or His;

Xaa at position 46 is Asp, Phe, Ser, Thr, Cys, Glu, Asn, Gln, Lys, His, Ala, Tyr, Ile, Val or Gly;

Xaa at position 47 is Ile, Gly, Val, Ser, Arg, Pro, or His;

Xaa at position 48 is Leu, Ser, Cys, Arg, Ile, His, Phe, Glu, Lys, Thr, Ala, Met, Val or Asn;

Xaa at position 49 is Met, Arg, Ala, Gly, Pro, Asn, His, or Asp;

Xaa at position 50 is Glu, Leu, Thr, Asp, Tyr, Lys, Asn, Ser, Ala, Ile, Val, His, Phe, Met or Gln;

Xaa at position 51 is Asn, Arg, Met, Pro, Ser, Thr, or His;

Xaa at position 52 is Asn, His, Arg, Leu, Gly, Ser, or Thr;

Xaa at position 53 is Leu, Thr, Ala, Gly, Glu, Pro, Lys, Ser, or Met;

Xaa at position 54 is Arg, Asp, Ile, Ser, Val, Thr, Gln, Asn, Lys, His, Ala or Leu;

Xaa at position 55 is Arg, Thr, Val, Ser, Leu, or Gly;

Xaa at position 56 is Pro, Gly, Cys, Ser, Gln, Glu, Arg, His, Thr, Ala, Tyr, Phe, Leu, Val or Lys;

Xaa at position 57 is Asn or Gly;

Xaa at position 58 is Leu, Ser, Asp, Arg, Gln, Val, or Cys;

Xaa at position 59 is Glu Tyr, His, Leu, Pro, or Arg;

Xaa at position 60 is Ala, Ser, Pro, Tyr, Asn, or Thr;

Xaa at position 61 is Phe, Asn, Glu, Pro, Lys, Arg, or Ser;

Xaa at position 62 is Asn, His, Val, Arg, Pro, Thr, Asp, or Ile;

Xaa at position 63 is Arg, Tyr, Trp, Lys, Ser, His, Pro, or Val;

Xaa at position 64 is Ala, Asn, Pro, Ser, or Lys;

Xaa at position 65 is Val, Thr, Pro, His, Leu, Phe, or Ser;

Xaa at position 66 is Lys, Ile, Arg, Val, Asn, Glu, or Ser;

Xaa at position 67 is Ser, Ala, Phe, Val, Gly, Asn, Ile, Pro, or His;

Xaa at position 68 is Leu, Val, Trp, Ser, Ile, Phe, Thr, or His;

Xaa at position 69 is Gln, Ala, Pro, Thr, Glu, Arg, Trp, Gly, or Leu;

Xaa at position 70 is Asn, Leu, Val, Trp, Pro, or Ala;

Xaa at position 71 is Ala, Met, Leu, Pro, Arg, Glu, Thr, Gln, Trp, or Asn;

Xaa at position 72 is Ser, Glu, Met, Ala, His, Asn, Arg, or Asp;

Xaa at position 73 is Ala, Glu, Asp, Leu, Ser, Gly, Thr, or Arg;

Xaa at position 74 is Ile, Met, Thr, Pro, Arg, Gly, Ala;

Xaa at position 75 is Glu, Lys, Gly, Asp, Pro, Trp, Arg, Ser, Gln, or Leu;

Xaa at position 76 is Ser, Val, Ala, Asn, Trp, Glu, Pro, Gly, or Asp;

Xaa at position 77 is Ile, Ser, Arg, Thr, or Leu;
Xaa at position 78 is Leu, Ala, Ser, Glu, Phe, Gly, or Arg;
Xaa at position 79 is Lys, Thr, Asn, Met, Arg, Ile, Gly, or Asp;
Xaa at position 80 is Asn, Trp, Val, Gly, Thr, Leu, Glu, or Arg;
Xaa at position 81 is Leu, Gln, Gly, Ala, Trp, Arg, Val, or Lys;
Xaa at position 82 is Leu, Gln, Lys, Trp, Arg, Asp, Glu, Asn, His, Thr, Ser, Ala, Tyr, Phe, Ile, Met or Val;
Xaa at position 83 is Pro, Ala, Thr, Trp, Arg, or Met;
Xaa at position 84 is Cys, Glu, Gly, Arg, Met, or Val;
Xaa at position 85 is Leu, Asn, Val, or Gln;
Xaa at position 86 is Pro, Cys, Arg, Ala, or Lys;
Xaa at position 87 is Leu, Ser, Trp, or Gly;
Xaa at position 88 is Ala, Lys, Arg, Val, or Trp;
Xaa at position 89 is Thr, Asp, Cys, Leu, Val, Glu, His, Asn, or Ser;
Xaa at position 90 is Ala, Pro, Ser, Thr, Gly, Asp, Ile, or Met;
Xaa at position 91 is Ala, Pro, Ser, Thr, Phe, Leu, Asp, or His;
Xaa at position 92 is Pro, Phe, Arg, Ser, Lys, His, Ala, Gly, Ile or Leu;
Xaa at position 93 is Thr, Asp, Ser, Asn, Pro, Ala, Leu, or Arg;
Xaa at position 94 is Arg, Ile, Ser, Glu, Leu, Val, Gln, Lys, His, Ala, or Pro;
Xaa at position 95 is His, Gln, Pro, Arg, Val, Leu, Gly, Thr, Asn, Lys, Ser, Ala, Trp, Phe, Ile, or Tyr;
Xaa at position 96 is Pro, Lys, Tyr, Gly, Ile, or Thr;
Xaa at position 97 is Ile, Val, Lys, Ala, or Asn;
Xaa at position 98 is His, Ile, Asn, Leu, Asp, Ala, Thr, Glu, Gln, Ser, Phe, Met, Val, Lys, Arg, Tyr or Pro;
Xaa at position 99 is Ile, Leu, Arg, Asp, Val, Pro, Gln, Gly, Ser, Phe, or His;
Xaa at position 100 is Lys, Tyr, Leu, His, Arg, Ile, Ser, Gln, or Pro;
Xaa at position 101 is Asp, Pro, Met, Lys, His, Thr, Val, Tyr, Glu, Asn, Ser, Ala, Gly, Ile, Leu, or Gln;
Xaa at position 102 is Gly, Leu, Glu, Lys, Ser, Tyr, or Pro;
Xaa at position 103 is Asp, or Ser;
Xaa at position 104 is Trp, Val, Cys, Tyr, Thr, Met, Pro, Leu, Gln, Lys, Ala, Phe, or Gly;
Xaa at position 105 is Asn, Pro, Ala, Phe, Ser, Trp, Gln, Tyr, Leu, Lys, Ile, Asp, or His;
Xaa at position 106 is Glu, Ser, Ala, Lys, Thr, Ile, Gly, or Pro;
Xaa at position 108 is Arg, Lys, Asp, Leu, Thr, Ile, Gln, His, Ser, Ala or Pro;
Xaa at position 109 is Arg, Thr, Pro, Glu, Tyr, Leu, Ser, or Gly;
Xaa at position 110 is Lys, Ala, Asn, Thr, Leu, Arg, Gln, His, Glu, Ser, or Trp;
Xaa at position 111 is Leu, Ile, Arg, Asp, or Met;
Xaa at position 112 is Thr, Val, Gln, Tyr, Glu, His, Ser, or Phe;
Xaa at position 113 is Phe, Ser, Cys, His, Gly, Trp, Tyr, Asp, Lys, Leu, Ile, Val or Asn;
Xaa at position 114 is Tyr, Cys, His, Ser, Trp, Arg, or Leu;
Xaa at position 115 is Leu, Asn, Val, Pro, Arg, Ala, His, Thr, Trp, or Met;
Xaa at position 116 is Lys, Leu, Pro, Thr, Met, Asp, Val, Glu, Arg, Trp, Ser, Asn, His, Ala, Tyr, Phe, Gln, or Ile;
Xaa at position 117 is Thr, Ser, Asn, Ile, Trp, Lys, or Pro;
Xaa at position 118 is Leu, Ser, Pro, Ala, Glu, Cys, Asp, or Tyr;
Xaa at position 119 is Glu, Ser, Lys, Pro, Leu, Thr, Tyr, or Arg;
Xaa at position 120 is Asn, Ala, Pro, Leu, His, Val, or Gln;
Xaa at position 121 is Ala, Ser, Ile, Asn, Pro, Lys, Asp, or Gly;
Xaa at position 122 is Gln, Ser, Met, Trp, Arg, Phe, Pro, His, Ile, Tyr, or Cys;
Xaa at position 123 is Ala, Met, Glu, His, Ser, Pro, Tyr, or Leu;

wherein from 1 to 14 amino acids can optionally be deleted from the N-terminus and/or from 1 to 15 amino acids can optionally be deleted from the C-terminus of said modified human IL-3 amino acid sequence; wherein from 0 to 44 of the amino acids designated by Xaa are different from the corresponding amino acids of native (1–133) human interleukin-3; and wherein the N-terminus is joined to the C-terminus directly or through a linker ($L_2$), capable of joining the N-terminus to the C-terminus and having new C- and N-termini at amino acids;

| | | |
|---|---|---|
| 26–27 | 49–50 | 83–84 |
| 27–28 | 50–51 | 84–85 |
| 28–29 | 51–52 | 85–86 |
| 29–30 | 52–53 | 86–87 |
| 30–31 | 53–54 | 87–88 |
| 31–32 | 54–55 | 88–89 |
| 32–33 | 64–65 | 89–90 |
| 33–34 | 65–66 | 90–91 |
| 34–35 | 66–67 | 91–92 |
| 35–36 | 67–68 | 92–93 |
| 36–37 | 68–69 | 97–98 |
| 37–38 | 69–70 | 98–99 |
| 38–39 | 70–71 | 99–100 |
| 39–40 | 71–72 | 100–101 |
| 40–41 | 72–73 | 101–102 |
| 41–42 | 82–83 | 102–103 |
| | | or 103–104 respectively; |

(VI) A polypeptide comprising; a modified human c-mpl ligand amino acid sequence of the formula:

```
SerProAlaProProAlaCysAspLeuArgValLeuSerLysLeuLeuArgAspSer  SEQ ID NO:860
1            5                10               15

HisValLeuHisSerArgLeuSerGlnCysProGluValHisProLeuProThrPro
20           25               30               35

ValLeuLeuProAlaValAspPheSerLeuGlyGluTrpLysThrGlnMetGluGlu
    40               45               50               55

ThrLysAlaGlnAspIleLeuGlyAlaValThrLeuLeuLeuGluGlyValMetAla
       60               65               70               75
```

-continued
```
AlaArgGlyGlnLeuGlyProThrCysLeuSerSerLeuLeuGlyGlnLeuSerGly
          80           85              90             95

GlnValArgLeuLeuLeuGlyAlaLeuGlnSerLeuLeuGlyThrGlnXaaXaaXaa
          100          105             110

XaaGlyArgThrThrAlaHisLysAspProAsnAlaIlePheLeuSerPheGlnHis
115          120             125             130

LeuLeuArgGlyLysValArgPheLeuMetLeuValGlyGlySerThrLeuCysVal
    135         140          145            150

Arg
153
``` wherein;

Xaa at position 112 is deleted or Leu, Ala, Val, Ile, Pro, Phe, Trp, or Met;

Xaa at position 113 is deleted or Pro, Phe, Ala, Val, Leu, Ile, Trp, or Met;

Xaa at position 114 is deleted or Pro, Phe, Ala, Val, Leu, Ile, Trp, or Met;

Xaa at position 115 is deleted or Gln, Gly, Ser, Thr, Tyr, or Asn; and wherein the N-terminus is joined to the C-terminus directly or through a linker (L$_2$) capable of joining the N-terminus to the C-terminus and having new C- and N-termini at amino acids;

| | | |
|---|---|---|
| 26–27 | 51–52 | 108–109 |
| 27–28 | 52–53 | 109–110 |
| 28–29 | 53–54 | 110–111 |
| 29–30 | 54–55 | 111–112 |
| 30–31 | 55–56 | 112–113 |
| 32–33 | 56–57 | 113–114 |
| 33–34 | 57–58 | 114–115 |
| 34–35 | 58–59 | 115–116 |
| 36–37 | 59–60 | 116–117 |
| 37–38 | 78–79 | 117–118 |
| 38–39 | 79–80 | 118–119 |
| 40–41 | 80–81 | 119–120 |
| 41–42 | 81–82 | 120–121 |
| 42–43 | 82–83 | 121–122 |
| 43–44 | 83–84 | 122–123 |
| 44–45 | 84–85 | 123–124 |
| 46–47 | 85–86 | 124–125 |
| 47–48 | 86–87 | 125–126 |
| 48–49 | 87–88 | 126–127 |
| 50–51 | 88–89 | or 127–128 respectively; |

(VII) A polypeptide comprising; a modified human IL-3 amino acid sequence of the formula:

```
Ala Pro Met Thr Gln Thr Thr Ser Leu Lys Thr Ser Trp Val Asn    SEQ ID NO:859
 1            5                    10                   15

Cys Xaa Xaa Xaa Xaa Xaa Xaa Xaa Xaa Xaa Xaa Xaa Xaa Xaa Xaa
             20                    25                   30

Xaa Xaa Xaa Xaa Xaa Xaa Xaa Xaa Asn Xaa Xaa Xaa Xaa Xaa Xaa
             35                    40                   45

Xaa Xaa Xaa Xaa Xaa Xaa Xaa Xaa Xaa Xaa Xaa Xaa Xaa Xaa Xaa
             50                    55                   60

Xaa Xaa Xaa Xaa Xaa Xaa Xaa Xaa Xaa Xaa Xaa Xaa Xaa Xaa Xaa
             65                    70                   75

Xaa Xaa Xaa Xaa Xaa Xaa Xaa Xaa Xaa Xaa Xaa Xaa Xaa Xaa Xaa
             80                    85                   90

Xaa Xaa Xaa Xaa Xaa Xaa Xaa Xaa Xaa Xaa Xaa Xaa Xaa Xaa Xaa
             95                   100                  105

Xaa Phe Xaa Xaa Xaa Xaa Xaa Xaa Xaa Xaa Xaa Xaa Xaa Xaa Xaa
            110                   115                  120

Xaa Xaa Xaa Gln Gln Thr Thr Leu Ser Leu Ala Ile Phe
            125                   130
``` wherein Xaa at position 17 is Ser, Lys, Gly, Asp, Met, Gln, or Arg;

Xaa at position 18 is Asn, His, Leu, Ile, Phe, Arg, or Gln;

Xaa at position 19 is Met, Phe, Ile, Arg, Gly, Ala, or Cys;

Xaa at position 20 is Ile, Cys, Gln, Glu, Arg, Pro, or Ala;

Xaa at position 21 is Asp, Phe, Lys, Arg, Ala, Gly, Glu, Gln, Asn, Thr, Ser or Val;
Xaa at position 22 is Glu, Trp, Pro, Ser, Ala, His, Asp, Asn, Gln, Leu, Val or Gly;
Xaa at position 23 is Ile, Val, Ala, Gly, Trp, Lys, Phe, Leu, Ser, or Arg;
Xaa at position 24 is Ile, Gly, Val, Arg, Ser, Phe, or Leu;
Xaa at position 25 is Thr, His, Gly, Gln, Arg, Pro, or Ala;
Xaa at position 26 is His, Thr, Phe, Gly, Arg, Ala, or Trp;
Xaa at position 27 is Leu, Gly, Arg, Thr, Ser, or Ala;
Xaa at position 28 is Lys, Arg, Leu, Gln, Gly, Pro, Val or Trp;
Xaa at position 29 is Gln, Asn, Leu, Pro, Arg, or Val;
Xaa at position 30 is Pro, His, Thr, Gly, Asp, Gln, Ser, Leu, or Lys;
Xaa at position 31 is Pro, Asp, Gly, Ala, Arg, Leu, or Gln;
Xaa at position 32 is Leu, Val, Arg, Gln, Asn, Gly, Ala, or Glu;
Xaa at position 33 is Pro, Leu, Gln, Ala, Thr, or Glu;
Xaa at position 34 is Leu, Val, Gly, Ser, Lys, Glu, Gln, Thr, Arg, Ala, Phe, Ile or Met;
Xaa at position 35 is Leu, Ala, Gly, Asn, Pro, Gln, or Val;
Xaa at position 36 is Asp, Leu, or Val;
Xaa at position 37 is Phe, Ser, Pro, Trp, or Ile;
Xaa at position 38 is Asn, or Ala;
Xaa at position 40 is Leu, Trp, or Arg;
Xaa at position 41 is Asn, Cys, Arg, Leu, His, Met, or Pro;
Xaa at position 42 is Gly, Asp, Ser, Cys, Asn, Lys, Thr, Leu, Val, Glu, Phe, Tyr, Ile, Met or Ala;
Xaa at position 43 is Glu, Asn, Tyr, Leu, Phe, Asp, Ala, Cys, Gln, Arg, Thr, Gly or Ser;
Xaa at position 44 is Asp, Ser, Leu, Arg, Lys, Thr, Met, Trp, Glu, Asn, Gln, Ala or Pro;
Xaa at position 45 is Gln, Pro, Phe, Val, Met, Leu, Thr, Lys, Trp, Asp, Asn, Arg, Ser, Ala, Ile, Glu or His;
Xaa at position 46 is Asp, Phe, Ser, Thr, Cys, Glu, Asn, Gln, Lys, His, Ala, Tyr, Ile, Val or Gly;
Xaa at position 47 is Ile, Gly, Val, Ser, Arg, Pro, or His;
Xaa at position 48 is Leu, Ser, Cys, Arg, Ile, His, Phe, Glu, Lys, Thr, Ala, Met, Val or Asn;
Xaa at position 49 is Met, Arg, Ala, Gly, Pro, Asn, His, or Asp;
Xaa at position 50 is Glu, Leu, Thr, Asp, Tyr, Lys, Asn, Ser, Ala, Ile, Val, His, Phe, Met or Gln;
Xaa at position 51 is Asn, Arg, Met, Pro, Ser, Thr, or His;
Xaa at position 52 is Asn, His, Arg, Leu, Gly, Ser, or Thr;
Xaa at position 53 is Leu, Thr, Ala, Gly, Glu, Pro, Lys, Ser, or Met;
Xaa at position 54 is Arg, Asp, Ile, Ser, Val, Thr, Gln, Asn, Lys, His, Ala or Leu;
Xaa at position 55 is Arg, Thr, Val, Ser, Leu, or Gly;
Xaa at position 56 is Pro, Gly, Cys, Ser, Gln, Glu, Arg, His, Thr, Ala, Tyr, Phe, Leu, Val or Lys;
Xaa at position 57 is Asn or Gly;
Xaa at position 58 is Leu, Ser, Asp, Arg, Gln, Val, or Cys;
Xaa at position 59 is Glu Tyr, His, Leu, Pro, or Arg;
Xaa at position 60 is Ala, Ser, Pro, Tyr, Asn, or Thr;
Xaa at position 61 is Phe, Asn, Glu, Pro, Lys, Arg, or Ser;
Xaa at position 62 is Asn, His, Val, Arg, Pro, Thr, Asp, or Ile;
Xaa at position 63 is Arg, Tyr, Trp, Lys, Ser, His, Pro, or Val;
Xaa at position 64 is Ala, Asn, Pro, Ser, or Lys;
Xaa at position 65 is Val, Thr, Pro, His, Leu, Phe, or Ser;
Xaa at position 66 is Lys, Ile, Arg, Val, Asn, Glu, or Ser;
Xaa at position 67 is Ser, Ala, Phe, Val, Gly, Asn, Ile, Pro, or His;
Xaa at position 68 is Leu, Val, Trp, Ser, Ile, Phe, Thr, or His;
Xaa at position 69 is Gln, Ala, Pro, Thr, Glu, Arg, Trp, Gly, or Leu;
Xaa at position 70 is Asn, Leu, Val, Trp, Pro, or Ala;
Xaa at position 71 is Ala, Met, Leu, Pro, Arg, Glu, Thr, Gln, Trp, or Asn;
Xaa at position 72 is Ser, Glu, Met, Ala, His, Asn, Arg, or Asp;
Xaa at position 73 is Ala, Glu, Asp, Leu, Ser, Gly, Thr, or Arg;
Xaa at position 74 is Ile, Met, Thr, Pro, Arg, Gly, Ala;
Xaa at position 75 is Glu, Lys, Gly, Asp, Pro, Trp, Arg, Ser, Gln, or Leu;
Xaa at position 76 is Ser, Val, Ala, Asn, Trp, Glu, Pro, Gly, or Asp;
Xaa at position 77 is Ile, Ser, Arg, Thr, or Leu;
Xaa at position 78 is Leu, Ala, Ser, Glu, Phe, Gly, or Arg;
Xaa at position 79 is Lys, Thr, Asn, Met, Arg, Ile, Gly, or Asp;
Xaa at position 80 is Asn, Trp, Val, Gly, Thr, Leu, Glu, or Arg;
Xaa at position 81 is Leu, Gin, Gly, Ala, Trp, Arg, Val, or Lys;
Xaa at position 82 is Leu, Gin, Lys, Trp, Arg, Asp, Glu, Asn, His, Thr, Ser, Ala, Tyr, Phe, Ile, Met or Val;
Xaa at position 83 is Pro, Ala, Thr, Trp, Arg, or Met;
Xaa at position 84 is Cys, Glu, Gly, Arg, Met, or Val;
Xaa at position 85 is Leu, Asn, Val, or Gin;
Xaa at position 86 is Pro, Cys, Arg, Ala, or Lys;
Xaa at position 87 is Leu, Ser, Trp, or Gly;
Xaa at position 88 is Ala, Lys, Arg, Val, or Trp;
Xaa at position 89 is Thr, Asp, Cys, Leu, Val, Glu, His, Asn, or Ser;
Xaa at position 90 is Ala, Pro, Ser, Thr, Gly, Asp, Ile, or Met;
Xaa at position 91 is Ala, Pro, Ser, Thr, Phe, Leu, Asp, or His;
Xaa at position 92 is Pro, Phe, Arg, Ser, Lys, His, Ala, Gly, Ile or Leu;
Xaa at position 93 is Thr, Asp, Ser, Asn, Pro, Ala, Leu, or Arg;
Xaa at position 94 is Arg, Ile, Ser, Glu, Leu, Val, Gln, Lys, His, Ala, or Pro;
Xaa at position 95 is His, Gin, Pro, Arg, Val, Leu, Gly, Thr, Asn, Lys, Ser, Ala, Trp, Phe, Ile, or Tyr;
Xaa at position 96 is Pro, Lys, Tyr, Gly, Ile, or Thr;
Xaa at position 97 is Ile, Val, Lys, Ala, or Asn;
Xaa at position 98 is His, Ile, Asn, Leu, Asp, Ala, Thr, Glu, Gin, Ser, Phe, Met, Val, Lys, Arg, Tyr or Pro;
Xaa at position 99 is Ile, Leu, Arg, Asp, Val, Pro, Gln, Gly, Ser, Phe, or His;
Xaa at position 100 is Lys, Tyr, Leu, His, Arg, Ile, Ser, Gln, or Pro;
Xaa at position 101 is Asp, Pro, Met, Lys, His, Thr, Val, Tyr, Glu, Asn, Ser, Ala, Gly, Ile, Leu, or Gin;
Xaa at position 102 is Gly, Leu, Glu, Lys, Ser, Tyr, or Pro;
Xaa at position 103 is Asp, or Ser;
Xaa at position 104 is Trp, Val, Cys, Tyr, Thr, Met, Pro, Leu, Gin, Lys, Ala, Phe, or Gly;
Xaa at position 105 is Asn, Pro, Ala, Phe, Ser, Trp, Gin, Tyr, Leu, Lys, Ile, Asp, or His;
Xaa at position 106 is Glu, Ser, Ala, Lys, Thr, Ile, Gly, or Pro;
Xaa at position 108 is Arg, Lys, Asp, Leu, Thr, Ile, Gln, His, Ser, Ala or Pro;
Xaa at position 109 is Arg, Thr, Pro, Glu, Tyr, Leu, Ser, or Gly;
Xaa at position 110 is Lys, Ala, Asn, Thr, Leu, Arg, Gln, His, Glu, Ser, or Trp;
Xaa at position 111 is Leu, Ile, Arg, Asp, or Met;
Xaa at position 112 is Thr, Val, Gln, Tyr, Glu, His, Ser, or Phe;

Xaa at position 113 is Phe, Ser, Cys, His, Gly, Trp, Tyr, Asp, Lys, Leu, Ile, Val or Asn;
Xaa at position 114 is Tyr, Cys, His, Ser, Trp, Arg, or Leu;
Xaa at position 115 is Leu, Asn, Val, Pro, Arg, Ala, His, Thr, Trp, or Met;
Xaa at position 116 is Lys, Leu, Pro, Thr, Met, Asp, Val, Glu, Arg, Trp, Ser, Asn, His, Ala, Tyr, Phe, Gln, or Ile;
Xaa at position 117 is Thr, Ser, Asn, Ile, Trp, Lys, or Pro;
Xaa at position 118 is Leu, Ser, Pro, Ala, Glu, Cys, Asp, or Tyr;
Xaa at position 119 is Glu, Ser, Lys, Pro, Leu, Thr, Tyr, or Arg;
Xaa at position 120 is Asn, Ala, Pro, Leu, His, Val, or Gln;
Xaa at position 121 is Ala, Ser, Ile, Asn, Pro, Lys, Asp, or Gly;
Xaa at position 122 is Gln, Ser, Met, Trp, Arg, Phe, Pro, His, Ile, Tyr, or Cys;
Xaa at position 123 is Ala, Met, Glu, His, Ser, Pro, Tyr, or Leu;
wherein from 1 to 14 amino acids can optionally be deleted from the N-terminus and/or from 1 to 15 amino acids can optionally be deleted from the C-terminus of said modified human IL-3 amino acid sequence; and
wherein from 1 to 44 of the amino acids designated by Xaa are different from the corresponding amino acids of native (1–133) human interleukin-3; and
(VIII) a factor selected from the group consisting of: a colony stimulating factor, a cytokine, a lymphokine, an interleukin;

and wherein $L_1$ is a linker capable of linking $R_1$ to $R_2$;

with the proviso that at least $R_1$ or $R_2$ is selected from the polypeptide of formula (I), (II), or (III); and said hematopoietic protein can optionally be immediately preceded by (methionine$^{-1}$), (alanine$^{-1}$) or (methionine$^{-2}$, alanine$^{-1}$).

The more preferred breakpoints at which new C-terminus and N-terminus can be made in the polypeptide (I) above are; 23–24, 24–25, 25–26, 27–28, 28–29, 29–30, 30–31, 31–32, 32–33, 33–34, 34–35, 35–36, 36–37, 37–38, 38–39, 40–41, 41–42, 42–43, 52–53, 53–54, 54–55, 55–56, 77–78, 78–79, 79–80, 80–81, 81–82, 82–83, 83–84, 84–85, 85–86, 86–87, 109–110, 110–111, 110–111, 111–112, 112–113, 113–114, 114–115, 115–116, 116–117, 117–118, 118–119, 119–120, 120–121, 121–122, 122–123, 123–124, 124–125, 125–126, 126–127, 127–128, 128–129, 129–130, 130–131, and 131–132.

The most preferred breakpoints at which new C-terminus and N-terminus can be made in the polypeptide (I) above are; 23–24, 24–25, 31–32, 32–33, 37–38, 38–39, 82–83, 83–84, 85–86, 86–87, 87–88, 125–126, 126–127 and 131–132.

The EPO receptor agonists of the present invention may contain amino acid substitutions, such as those disclosed in WO 94/24160 or one or more of the glycosylation sites at $Asn^{24}$, $Asn^{83}$, and $Asn^{126}$ are changed to other amino acids such as but not limited to Asp or Glu, deletions and/or insertions. It is also intended that the EPO receptor agonists of the present invention may also have amino acid deletions at either/or both the N- and C-termini of the original protein and or deletions from the new N- and/or C-termini of the sequence rearranged proteins in the formulas shown above.

The more preferred breakpoints at which new C-terminus and N-terminus can be made in the polypeptide (II) above are; 23–24, 24–25, 25–26, 33–34, 34–35, 35–36, 36–37, 38–39, 39–40, 40–41, 64–65, 65–66, 66–67, 67–68, 68–69, 69–70, 70–71, 89–90, 90–91, 91–92, 9–93, 93–94, 94–95, 95–96, 96–97, 97–98, 98–99, 99–100, 100–101, 101–102, 102–103, 103–104, 104–105 and 105–106 respectively.

The most preferred breakpoints at which new C-terminus and N-terminus can be made in the polypeptide (II) above are; 64–65, 65–66, 92–93 and 93–94 respectively.

The more preferred breakpoints at which new C-terminus and N-terminus can be made in the polypeptide (III) above are; 36–37, 37–38, 39–40, 41–42, 42–43, 64–65, 65–66, 66–67, 86–87, 87–88, 88–89, 89–90, 90–91, 91–92, 92–93, 93–94, 94–95, 95,–96, 96–97, 97–98, 98–99, 99–100 and 100–101

The most preferred breakpoints at which new C-terminus and N-terminus can be made in the polypeptide (III) above are; 39–40, 65–66, 89–90, 99–100 and 100–101.

The more preferred breakpoints at which new C-terminus and N-terminus can be made in the polypeptide (IV) above are; 38–39, 39–40, 40–41, 41–42, 48–49, 53–54, 54–55, 55–56, 56–57, 57–58, 58–59, 59–60, 60–61, 61–62, 62–63, 64–65, 65–66, 66–67, 67–68, 68–69, 69–70, 96–97, 125–126, 126–127, 127–128, 128–129, 129–130, 130–131, 131–132, 132–133, 133–134, 134–135, 135–136, 136–137, 137–138, 138–139, 139–140, 140–141 and 141–142.

The most preferred breakpoints at which new C-terminus and N-terminus can be made in the polypeptide (IV) above are; 38–39, 48–49, 96–97, 125–126, 132–133 and 141–142.

The more preferred breakpoints at which new C-terminus and N-terminus can be made in the polypeptide (V) above are; 28–29, 29–30, 30–31, 31–32, 32–33, 33–34, 34–35, 35–36, 36–37, 37–38, 38–39, 39–40, 66–67, 67–68, 68–69, 69–70, 70–71, 84–85, 85–86, 86–87, 87–88, 88–89, 89–90, 90–91, 98–99, 99–100, 100–101 and 101–102.

The most preferred breakpoints at which new C-terminus and N-terminus can be made in the polypeptide (V) above are; 34–35, 69–70 and 90–91.

The more preferred breakpoints at which new C-terminus and N-terminus can be made in the polypeptide (VI) above are; 80–81, 81–82, 82–83, 83–84, 84–85, 85–86, 86–87, 108–109, 109–110, 110–111, 111–112, 112–113, 113–114, 114–115, 115–116, 116–117, 117–118, 118–119, 119–120, 120–121, 121–122, 122–123, 123–124, 124–125, 125–126 and 126–127.

The most preferred breakpoints at which new C-terminus and N-terminus can be made in the polypeptide (VI) above are; 81–82, 108–109, 115–116, 119–120, 122–123 and 125–126.

The multi-functional receptor agonist of the present invention can also be represented by the following formulas:

$$(T^1)_a\text{-}(L^1)_b\text{-}X^1\text{-}(L)_c\text{-}X^2\text{-}(L^2)_d\text{-}(T^2)_e$$

or $$X^1\text{-}(L)_c\text{-}X^2\text{-}(L)\text{-}Y^1\text{-}(L)_c\text{-}Y^2$$

in which:

$X^1$ is a peptide comprising an amino acid sequence corresponding to the sequence of residues n+1 through J of the original protein having amino acids residues numbered sequentially 1 through J with an amino terminus at residue 1;

L is an optional linker;

$X^2$ is a peptide comprising an amino acid sequence of residues 1 through n of the original protein;

$Y^1$ is a peptide comprising an amino acid sequence corresponding to the sequence of residues n=1 through K of the original protein having amino acids residues numbered sequentially 1 through K with an amino terminus at residue 1;

$Y^2$ is a peptide comprising an amino acid sequence of residues 1 through n of the original protein;

L¹ and L² are optional peptide spacers:
n is an integer ranging from 1 to J—1;
b, c, and d are each independently 0 or 1;
a and e are either 0 or 1, provided that both a and e cannot both be 0; and
T¹ and T² are proteins.

The multi-functional chimeric hematopoietic receptor agonists of the present invention may contain amino acid substitutions, deletions and/or insertions in the individual protein components of the chimera molecule. It is also intended that the multi-functional chimeric hematopoietic receptor agonists of the present invention may also have amino acid deletions at either/or both the N- and C-termini of the original protein and or deletions from the new N- and/or C-termini of the sequence rearranged proteins in the formulas shown above.

A preferred embodiment of the present invention the linker (L), (L¹) or (L²), of the above formulas, joining the N-terminus to the C-terminus is a polypeptide selected from the group consisting of:

Ser;
Asn;
Gly;
Thr;
GlySer;
AlaAla;
GlySerGly;
GlyGlyGly;
GlyAsnGly;
GlyAlaGly;
GlyThrGly;
AlaSerAla;
AlaAlaAla;
GlyGlyGlySer SEQ ID NO:778;
GlyGlyGlySerGlyGlyGlySer SEQ ID NO:779;
GlyGlyGlySerGlyGlyGlySerGlyGlyGlySer SEQ ID NO:780;
SerGlyGlySerGlyGlySer SEQ ID NO:781;
GluPheGlyAsnMet SEQ ID NO:782;
GluPheGlyGlyAsnMet SEQ ID NO:783;
GluPheGlyGlyAsnGlyGlyAsnMet SEQ ID NO:784;
GlyGlySerAspMetAlaGly SEQ ID NO:785;
SerGlyGlyAsnGly SEQ ID NO:786;
SerGlyGlyAsnGlySerGlyGlyAsnGly SEQ ID NO:787;
SerGlyGlyAsnGlySerGlyGlyAsnGlySerGlyGlyAsnGly SEQ ID NO:788;
SerGlyGlySerGlySerGlyGlySerGly SEQ ID NO:789;
SerGlyGlySerGlySerGlyGlySerGlySerGlyGlySerGly SEQ ID NO:790;
GlyGlyGlySerGlyGly SEQ ID NO:791;
GlyGlyGlySerGlyGlyGly SEQ ID NO:792;
GlyGlyGlySerGlyGlyGlySerGlyGly SEQ ID NO:793;
GlyGlyGlySerGlyGlyGlySerGlyGlyGlySerGly SEQ ID NO:794;
GlyGlyGlySerGlyGlyGlySerGlyGlyGlySerGlyGly SEQ ID NO:795;
GlyGlyGlySerGlyGlyGlySerGlyGlyGlySerGlyGly-SerGlyGlyGlySerGly SEQ ID NO:796;
ProProProTrpSerProArgProLeuGlyAlaThrAlaProThr-AlaGlyGlnProProLeu SEQ ID NO:797;
ProProProTrpSerProArgProLeuGlyAlaThrAlaProThr SEQ ID NO:798; and ValGluThrValPheHisArgValSerGlnAspGlyLeuLeu-ThrSer SEQ ID NO:799.

Additionally, the present invention relates to recombinant expression vectors comprising nucleotide sequences encoding the multi-functional chimeric hematopoietic receptor agonists, related microbial expression systems, and processes for making the multi-functional chimeric hematopoietic receptor agonists. The invention also relates to pharmaceutical compositions containing the multi-functional chimeric hematopoietic receptor agonists, and methods for using the multi-functional chimeric hematopoietic receptor agonists.

In addition to the use of the multi-functional chimeric hematopoietic receptor agonists of the present invention in vivo, it is envisioned that in vitro uses would include the ability to stimulate bone marrow and blood cell activation and growth before infusion into patients. Another intended use is for the production of dendritic cells both in vivo and ex vivo.

It is believed that the reduced affinity of fusion proteins is due, at least in part, to the inability of the individual moieties to achieve their native conformation when incorporated into a chimeric molecule or to steric hindrance between the active site of the individual moieties of the fusion protein. This invention overcomes these limitations providing novel multi-functional chimeric hematopoietic receptor agonists that have a binding affinity comparable to or greater than the individual components of the chimeric molecule.

BRIEF DESCRIPTION OF THE FIGURES

FIG. 6 shows a DNA sequence encoding human mature EPO based on the sequence of Lin et al. (*PNAS* 82:7580–7584, 1985).

FIGS. 7a and 7b shows a DNA sequence encoding native stem cell factor based on the sequence of Martin et al. (*Cell* 63:203–211, 1990).

FIG. 8 shows a DNA sequence encoding soluble stem cell factor based on the sequence of Langley et al. (*Archives of Bichemistry and Biophysica* 311:55–61, 1994).

FIGS. 9a and 9b shows the DNA sequence encoding the 209 amino acid mature form of flt3 ligand from Lyman et al. (*Oncogene* 11:1165–1172, 1995).

FIG. 10 shows the DNA sequence encoding the 134 amino acid soluble form of flt3 ligand from Lyman et al. (*Oncogene* 11:1165–1172, 1995).

DETAILED DESCRIPTION OF THE INVENTION

Figure 1:
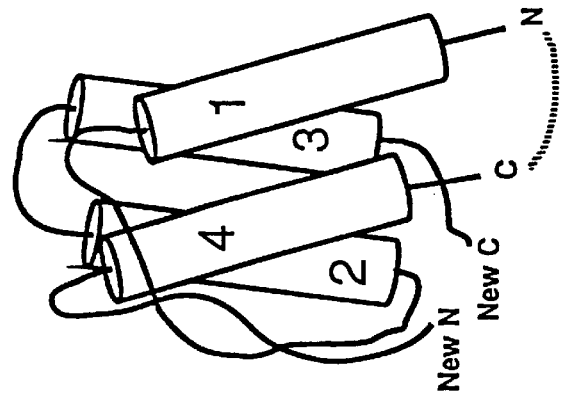
FIG. 1 schematically illustrates the sequence rearrangement of a protein. The N-terminus (N) and the C-terminus (C) of the native protein are joined through a linker, or joined directly. The protein is opened at a breakpoint creating a new N-terminus (new N) and a new C-terminus (new-C) resulting in a protein with a new linear amino acid sequence. A rearranged molecule may be synthesized de novo as linear molecule and not go through the steps of joining the original N-terminus and the C-terminus and opening of the protein at the breakpoint.
Figure 1:
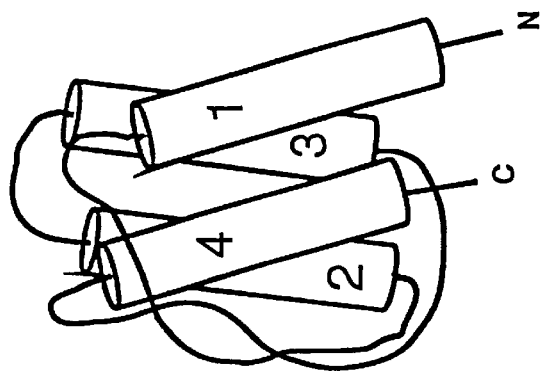
Figure 1:
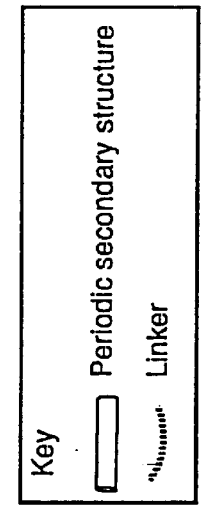

The present invention encompasses multi-functional chimeric hematopoietic receptor agonists formed from covalently linked polypeptides, each of which may act through a different and specific cell receptor to initiate complementary biological activities. Hematopoiesis requires a complex series of cellular events in which stem cells generate continuously into large populations of maturing cells in all major lineages. There are currently at least 20 known regulators with hematopoietic proliferative activity. Most of these proliferative regulators can only stimulate one or another type of colony formation in vitro, the precise pattern of colony formation stimulated by each regulator is quite distinctive. No two regulators stimulate exactly the same pattern of colony formation, as evaluated by colony numbers or, more importantly, by the lineage and maturation pattern of the cells making up the developing colonies. Proliferative responses can most readily be analyzed in simplified in vitro culture systems. Three quite different parameters can be distinguished: alteration in colony size, alteration in colony numbers and cell lineage. Two or more factors may act on the progenitor cell, inducing the formation of larger number of progeny thereby increasing the colony size. Two or more factors may allow increased number of progenitor cells to proliferate either because distinct subsets of progenitors cells exist that respond exclusively to one factor or because some progenitors require stimulation by two or more factors before being able to respond. Activation of additional receptors on a cell by the use of two or more factors is likely to enhance the mitotic signal because of coalescence of initially differing signal pathways into a common final pathway reaching the nucleus (Metcalf, *Nature* 339:27, 1989). Other mechanisms could explain synergy. For example, if one signaling pathway is limited by an intermediate activation of an additional signaling pathway which is caused by a second factor, then this may result in a super additive response. In some cases, activation of one receptor type can induce an enhanced expression of other receptors (Metcalf, *Blood* 82:3515–3523, 1993). Two or more factors may result in a different pattern of cell lineages than from a single factor. The use of multi-functional chimeric hematopoietic receptor agonists may have a potential clinical advantage resulting from a proliferative response that is not possible by any single factor.

The receptors of hematopoietic and other growth factors can be grouped into two distinct families of related proteins: (1) tyrosine kinase receptors, including those for epidermal growth factor, M-CSF (Sherr, *Blood* 75:1, 1990) and SCF (Yarden et al., *EMBO J.* 6:3341, 1987): and (2) hematopoietic receptors, not containing a tyrosine kinase domain, but exhibiting obvious homology in their extracellular domain (Bazan, *PNAS USA* 87:6934–6938, 1990). Included in this latter group are erythropoietin (EPO) (D'Andrea et al., *Cell* 57:277, 1989), GM-CSF (Gearing et al., *EMBO J.* 8:3667, 1989), IL-3 (Kitamura et al., *Cell* 66:1165, 1991), G-CSF (Fukunaga et al., *J. Bio. Chem.* 265:14008–15, 1990), IL-4 (Harada et al., *PNAS USA* 87:857, 1990), IL-5 (Takaki et al., *EMBO J.* 9:4367, 1990), IL-6 (Yamasaki et al., *Science* 241:825, 1988), IL-7 (Goodwin et al., *Cell* 60:941–51, 1990), LIF (Gearing et al., *EMBO J.* 10:2839, 1991) and IL-2 (Cosman et al., *Mol*-Immunol. 23: 935–94, 1986). Most of the latter group of receptors exists in a high-affinity form as heterodimers. After ligand binding, the specific a-chains become associated with at least one other receptor chain (b-chain, g-chain). Many of these factors share a common receptor subunit. The a-chains for GM-CSF, IL-3 and IL-5 share the same b-chain (Kitamura et al., *Cell* 66:1165, 1991), Takaki et al., *EMBO J.* 10:2833–8, 1991) and receptor complexes for IL-6, LIF and IL-11 share a common b-chain (gp130) (Taga et al., *Cell* 58:573–81, 1989; Gearing et al., *Science* 255:1434–7, 1992). The receptor complexes of IL-2, IL-4, IL-7, IL-9 and IL-15 share a common g-chain (Kondo et al., *Science* 262:1874, 1993; Russell et al., *Science* 266: 1042–1045, 1993; Noguchi et al., *Science* 262:1877, 1993; Giri et al., *EMBO J.* 13:2822–2830, 1994).

The use of a multiply acting hematopoietic factor may also have a potential advantage by reducing the demands placed on factor-producing cells and their induction systems. If there are limitations in the ability of a cell to produce a factor, then by lowering the required concentrations of each of the factors, and using them in combination may usefully reduce demands on the factor-producing cells. The use of a multiply acting hematopoietic factor may lower the amount of the factors that would be needed, probably reducing the likelihood of adverse side-effects.

Novel compounds of this invention are represented by a formula selected from the group consisting of:

$R_1$-$L_1$-$R_2$, $R_2$-$L_1$-$R_1$, $R_1$-$R_2$, and $R_2$-$R_1$

Where $R_1$ and $R_2$ are as defined above.

$R_2$ is preferably a colony stimulating factor with a different but complementary activity than $R_1$. By complementary activity is meant activity which enhances or changes the response to another cell modulator. The $R_1$ polypeptide is joined either directly or through a linker segment to the $R_2$ polypeptide. The term "directly" defines multi-functional chimeric hematopoietic receptor agonists in which the polypeptides are joined without a peptide linker. Thus $L_1$ represents a chemical bond or polypeptide segment to which both $R_1$ and $R_2$ are joined in frame, most commonly $L_1$ is a linear peptide to which $R_1$ and $R_2$ are joined by amide bonds linking the carboxy terminus of $R_1$ to the amino terminus of $L_1$ and carboxy terminus of $L_1$ to the amino terminus of $R_2$. By "joined in frame" is meant that there is no translation termination or disruption between the reading frames of the DNA encoding $R_1$ and $R_2$.

A non-exclusive list of other growth factors, i.e. colony stimulating factors (CSFs), are cytokines, lymphokines, interleukins, hematopoietic growth factors which can be joined to (I), (II) or (III) include GM-CSF, G-CSF, c-mpl ligand (also known as TPO or MGDF), M-CSF, erythropoietin (EPO), IL-1, IL-4, IL-2, IL-3, IL-5, IL-6, IL-7, IL-8, IL-9, IL-10, IL-11, IL-12, IL-13, IL-15, LIF, flt3/flk2 ligand, human growth hormone, B-cell growth factor, B-cell differentiation factor, eosinophil differentiation factor and stem cell factor (SCF) also known as steel factor or c-kit ligand. Additionally, this invention encompasses the use of modified $R_1$ or $R_2$ molecules or mutated or modified DNA sequences encoding these $R_1$ or $R_2$ molecules. The present invention also includes multi-functional chimeric hematopoietic receptor agonists in which $R_1$ or $R_2$ is an hIL-3 variant, c-mpl ligand variant, or G-CSF variant. A "hIL-3 variant" is defined as a hIL-3 molecule which has amino acid substitutions and/or portions of hIL-3 deleted as disclosed in U.S. Pat. No. 5,604,116; U.S. Pat. No. 5,817,486; U.S. application Ser. No. 08/469,419 now U.S. Pat. No. 6,458,931; and U.S. application Ser. No. 08/470,081, now U.S. Pat. No. 6,051,217, U.S. Pat. No. 5,677,149; U.S. application Ser. No. 08/468,588; U.S. application Ser. No. 08/466,165, now abandoned; and U.S. application Ser. No. 08/471,039, now U.S. Pat. No. 6,017,523 and WO 95/00646, as well as other variants known in the art. A "c-mpl ligand variant" is defined an c-mpl ligand molecule which has amino acid substitutions and/or portions of c-mpl ligand deleted, disclosed in U.S. application Ser. No. 08/383,035 as well as other variants known in the art. A "G-CSF variant" is defined an G-CSF molecule which has amino acid substitutions and/or portions of G-CSF deleted, as disclosed herein, as well as other variants known in the art. In addition to the list above, IL-3 variants taught in WO 94/12639 and WO 94/12638, G-CSF receptor agonists disclosed in WO 97/12977, c-mpl receptor agonists disclosed in WO 97/12978, IL-3 receptor agonists disclosed in WO 97/12979 can be $R_1$ or $R_2$ of the present invention. As used herein "IL-3 variants" refer to IL-3 variants taught in WO 94/12639 and WO 94/12638. As used herein "fusion proteins" refer to fusion protein taught in U.S. Pat. No. 5,738,849; U.S. Pat. No. 5,858,347; U.S. application Ser. No. 08/469,124, now U.S. Pat. No. 6,132,991; Ser. No. 08/466,648, pending; and U.S. application Ser. No. 08/559,267, now U.S. Pat. No. 6,074,639, and U.S. Ser. No. 08/192,325; U.S. application Ser. No. U.S. application Ser. No. 08/469,318, now U.S. Pat. No. 6,022,535; U.S. application Ser. No. 08/468,609, now U.S. Pat. No. 6,030,812; U.S. application Ser. No. 08/466,631 pending; and U.S. application Ser. No. 08/762,227, now U.S. Pat. No. 6,436,387. As used herein "G-CSF receptor agonists" refer to G-CSF receptor agonists disclosed in WO 97/12978. As used herein "c-mpl receptor agonists" refer to c-mpl receptor agonists disclosed in WO 97/12978. As used herein "IL-3 receptor agonists" refer to IL-3 receptor agonists disclosed in WO 97/12979. As used herein "multi-functional receptor agonists" refer to multi-functional receptor agonists taught in U.S. application Ser. No. 08/835,162.

The linking group ($L_1$) is generally a polypeptide of between 1 and 500 amino acids in length. The linkers joining the two molecules are preferably designed to (1) allow the two molecules to fold and act independently of each other, (2) not have a propensity for developing an ordered secondary structure which could interfere with the functional domains of the two proteins, (3) have minimal hydrophobic characteristics which could interact with the functional protein domains and (4) provide steric separation of $R_1$ and $R_2$ such that $R_1$ and $R_2$ could interact simultaneously with their corresponding receptors on a single cell. Typically surface amino acids in flexible protein regions include Gly, Asn and Ser. Virtually any permutation of amino acid sequences containing Gly, Asn and Ser would be expected to satisfy the above criteria for a linker sequence. Other neutral amino acids, such as Thr and Ala, may also be used in the linker sequence. Additional amino acids may also be included in the linkers due to the addition of unique restriction sites in the linker sequence to facilitate construction of the multi-functional chimeric hematopoietic receptor agonists.

Preferred $L_1$ linkers of the present invention include sequences selected from the group of formulas: $(Gly^3Ser)^n$ (SEQ ID NO:861), $(Gly^4Ser)^n$ (SEQ ID NO:862), $(Gly^5Ser)^n$ (SEQ ID NO:863), $(Gly^nSer)^n$ (SEQ ID NO:864) or $(AlaGlySer)^n$ (SEQ ID NO:865).

One example of a highly-flexible linker is the glycine and serine-rich spacer region present within the pIII protein of the filamentous bacteriophages, e.g. bacteriophages M13 or fd (Schaller et al., *PNAS USA* 72: 737–741, 1975). This region provides a long, flexible spacer region between two domains of the pIII surface protein. The spacer region consists of the amino acid sequence:
GlyGlyGlySerGlyGlyGlySerGlyGlyGlySerGluGlyGlyGly-
   SerGluGlyGlyGlySerGluGlyGlyGlySerGluGlyGlyGly-
   SerGlyGlyGlySer (SEQ ID NO:800).

The present invention also includes linkers in which an endopeptidase recognition sequence is included. Such a cleavage site may be valuable to separate the individual components of the multi-functional chimeric hematopoietic receptor agonist to determine if they are properly folded and active in vitro. Examples of various endopeptidases include, but are not limited to, plasmin, enterokinase, kallikrein, urokinase, tissue plasminogen activator, clostripain, chymosin, collagenase, Russell's viper venom protease, postproline cleavage enzyme, V8 protease, Thrombin and factor Xa.

Peptide linker segments from the hinge region of heavy chain immunoglobulins IgG, IgA, IgM, IgD or IgE provide an angular relationship between the attached polypeptides. Especially useful are those hinge regions where the cysteines are replaced with serines. Preferred linkers of the present invention include sequences derived from murine IgG gamma 2b hinge region in which the cysteines have been changed to serines. These linkers may also include an endopeptidase cleavage site. Examples of such linkers include the following sequences:
IleSerGluProSerGlyProIleSerThrIleAsnProSerProProSer-
   LysGluSerHisLysSerPro (SEQ ID NO:801) and
IleGluGlyArgIleSerGluProSerGlyProIleSerThrIleAsnPro-
   SerProProSerLysGluSerHisLysSerPro (SEQ ID NO:802).

The present invention is, however, not limited by the form, size or number of linker sequences employed and the only requirement of the linker is that functionally it does not interfere with the folding and function of the individual molecules of the multi-functional chimeric hematopoietic receptor agonist.

Determination of the Linker $L_2$.

The length of the amino acid sequence of the linker $L_2$ to be used in $R_1$ and/or $R_2$ can be selected empirically or with guidance from structural information, or by using a combination of the two approaches.

When no structural information is available, a small series of linkers can be prepared for testing using a design whose length is varied in order to span a range from 0 to 50 Å and whose sequence is chosen in order to be consistent with surface exposure (hydrophilicity, Hopp & Woods, *Mol. Immunol.* 20: 483–489, 1983), Kyte & Doolittle, *J. Mol. Biol.* 157:105–132; solvent exposed surface area, Lee & Richards, *J. Mol. Biol.* 55:379–400, 1971) and the ability to adopt the necessary conformation with out deranging the conformation of $R^1$ or $R^2$ (conformationally flexible; Karplus & Schulz, *Naturwissenschaften* 72:212–213, 1985). Assuming an average of translation of 2.0 to 3.8 Å per residue, this would mean the length to test would be between 0 to 30 residues, with 0 to 15 residues being the preferred range. Exemplary of such an empirical series would be to construct linkers using a cassette sequence such as "Gly-Gly-Gly-Ser" SEQ. ID NO. 778 repeated n times, where n is 1, 2, 3 or 4. Those skilled in the art will recognize that there are many such sequences that vary in length or composition that can serve as linkers with the primary consideration being that they be neither excessively long nor short (cf., Sandhu, *Critical Rev. Biotech.* 12: 437–462, 1992); if they are too long, entropy effects will likely destabilize the three-dimensional fold, and may also make folding kinetically impractical, and if they are too short, they will likely destabilize the molecule because of torsional or steric strain.

Those skilled in the analysis of protein structural information will recognize that using the distance between the chain ends, defined as the distance between the c-alpha carbons, can be used to define the length of the sequence to be used, or at least to limit the number of possibilities that must be tested in an empirical selection of linkers. They will also recognize that it is sometimes the case that the positions of the ends of the polypeptide chain are ill-defined in structural models derived from x-ray diffraction or nuclear magnetic resonance spectroscopy data, and that when true, this situation will therefore need to be taken into account in order to properly estimate the length of the linker required. From those residues whose positions are well defined are selected two residues that are close in sequence to the chain ends, and the distance between their c-alpha carbons is used to calculate an approximate length for a linker between them. Using the calculated length as a guide, linkers with a range of number of residues (calculated using 2 to 3.8 Å per residue) are then selected. These linkers may be composed of the original sequence, shortened or lengthened as necessary, and when lengthened the additional residues may be chosen to be flexible and hydrophilic as described above; or optionally the original sequence may be substituted for using a series of linkers, one example being the "Gly-Gly-Gly-Ser" cassette approach mentioned above; or optionally a combination of the original sequence and new sequence having the appropriate total length may be used.

Determination of the Amino and Carboxyl Termini of $R_1$ and $R_2$

Sequences of $R_1$ and $R_2$ capable of folding to biologically active states can be prepared by appropriate selection of the beginning (amino terminus) and ending (carboxyl terminus) positions from within the original polypeptide chain while using the linker sequence $L_2$ as described above. Amino and carboxyl termini are selected from within a common stretch of sequence, referred to as a breakpoint region, using the guidelines described below. A novel amino acid sequence is thus generated by selecting amino and carboxyl termini from within the same breakpoint region. In many cases the selection of the new termini will be such that the original position of the carboxyl terminus immediately preceded that of the amino terminus. However, those skilled in the art will recognize that selections of termini anywhere within the region may function, and that these will effectively lead to either deletions or additions to the amino or carboxyl portions of the new sequence.

It is a central tenet of molecular biology that the primary amino acid sequence of a protein dictates folding to the three-dimensional structure necessary for expression of its biological function. Methods are known to those skilled in the art to obtain and interpret three-dimensional structural information using x-ray diffraction of single protein crystals or nuclear magnetic resonance spectroscopy of protein solutions. Examples of structural information that are relevant to the identification of breakpoint regions include the location and type of protein secondary structure (alpha and 3–10 helices, parallel and anti-parallel beta sheets, chain reversals and turns, and loops; Kabsch & Sander, *Biopolymers* 22: 2577–2637, 1983), the degree of solvent exposure of amino acid residues, the extent and type of interactions of residues with one another (Chothia, *Ann. Rev. Biochem.* 53:537–572, 1984) and the static and dynamic distribution of conformations along the polypeptide chain (Alber & Mathews, *Methods Enzymol.* 154: 511–533, 1987). In some cases additional information is known about solvent exposure of residues; one example is a site of post-translational attachment of carbohydrate which is necessarily on the surface of the protein. When experimental structural information is not available, or is not feasible to obtain, methods are also available to analyze the primary amino acid sequence in order to make predictions of protein tertiary and secondary structure, solvent accessibility and the occurrence of turns and loops. Biochemical methods are also sometimes applicable for empirically determining surface exposure when direct structural methods are not feasible; for example, using the identification of sites of chain scission following limited proteolysis in order to infer surface exposure (Gentile & Salvatore, *Eur. J. Biochem.* 218:603–621, 1993)

Thus using either the experimentally derived structural information or predictive methods (e.g., Srinivisan & Rose *Proteins: Struct., Funct. & Genetics,* 22: 81–99, 1995) the parental amino acid sequence is inspected to classify regions according to whether or not they are integral to the maintenance of secondary and tertiary structure. The occurrence of sequences within regions that are known to be involved in periodic secondary structure (alpha and 3–10 helices, parallel and anti-parallel beta sheets) are regions that should be avoided. Similarly, regions of amino acid sequence that are observed or predicted to have a low degree of solvent exposure are more likely to be part of the so-called hydrophobic core of the protein and should also be avoided for selection of amino and carboxyl termini. In contrast, those regions that are known or predicted to be in surface turns or loops, and especially those regions that are known not to be required for biological activity, are the preferred sites for location of the extremes of the polypeptide chain. Continuous stretches of amino acid sequence that are preferred based on the above criteria are referred to as a breakpoint region.

Additional peptide sequences may also be added to facilitate purification or identification of multi-functional chimeric hematopoietic receptor agonist proteins (e.g., poly-His). A highly antigenic peptide may also be added that would enable rapid assay and facile purification of the multi-functional chimeric hematopoietic receptor agonist protein by a specific monoclonal antibody.

"Mutant amino acid sequence," "mutant protein", "variant protein", "mutein", or "mutant polypeptide" refers to a polypeptide having an amino acid sequence which varies from a native sequence due to amino acid deletions, substitutions, or both, or is encoded by a nucleotide sequence intentionally made variant from a native sequence. "Native sequence" refers to an amino acid or nucleic acid sequence which is identical to a wild-type or native form of a gene or protein.

Hematopoietic growth factors can be characterized by their ability to stimulate colony formation by human hematopoietic progenitor cells. The colonies formed include erythroid, granulocyte, megakaryocyte, granulocytic macrophages and mixtures thereof. Many of the hematopoietic growth factors have demonstrated the ability to restore bone marrow function and peripheral blood cell populations to therapeutically beneficial levels in studies performed initially in primates and subsequently in humans. Many or all of these biological activities of hematopoietic growth factors involve signal transduction and high affinity receptor binding. Multi-functional chimeric hematopoietic receptor agonists of the present invention may exhibit useful properties such as having similar or greater biological activity when compared to a single factor or by having improved half-life or decreased adverse side effects, or a combination of these properties.

Multi-functional chimeric hematopoietic receptor agonists which have little or no agonist activity maybe useful as antagonists, as antigens for the production of antibodies for use in immunology or immunotherapy, as genetic probes or as intermediates used to construct other useful hIL-3 muteins.

Biological activity of the multi-functional chimeric hematopoietic receptor agonist proteins of the present invention can be determined by DNA synthesis in factor-dependent cell lines or by counting the colony forming units in an in vitro bone marrow assay.

The multi-functional chimeric hematopoietic receptor agonists of the present invention may have an improved therapeutic profile as compared to single acting hematopoietic agonists. For example, some multi-functional chimeric hematopoietic receptor agonists of the present invention may have a similar or more potent growth factor activity relative to other hematopoietic agonists without having a similar or corresponding increase in side-effects.

The present invention also includes the DNA sequences which code for the multi-functional chimeric hematopoietic receptor agonist proteins, DNA sequences which are substantially similar and perform substantially the same function, and DNA sequences which differ from the DNAs encoding the multi-functional chimeric hematopoietic receptor agonists of the invention only due to the degeneracy of the genetic code. Also included in the present invention are the oligonucleotide intermediates used to construct the mutant DNAs and the polypeptides coded for by these oligonucleotides.

Genetic engineering techniques now standard in the art (U.S. Pat. No. 4,935,233 and Sambrook et al., "Molecular Cloning A Laboratory Manual", Cold Spring Harbor Laboratory, 1989) may be used in the construction of the DNA sequences of the present invention. One such method is cassette mutagenesis (Wells et al., *Gene* 34:315–323, 1985) in which a portion of the coding sequence in a plasmid is replaced with synthetic oligonucleotides that encode the desired amino acid substitutions in a portion of the gene between two restriction sites.

Pairs of complementary synthetic oligonucleotides encoding the desired gene can be made and annealed to each other. The DNA sequence of the oligonucleotide would encode sequence for amino acids of desired gene with the exception of those substituted and/or deleted from the sequence.

Plasmid DNA can be treated with the chosen restriction endonucleases then ligated to the annealed oligonucleotides. The ligated mixtures can be used to transform competent JM101 cells to resistance to an appropriate antibiotic. Single colonies can be picked and the plasmid DNA examined by restriction analysis and/or DNA sequencing to identify plasmids with the desired genes.

Cloning of the DNA sequences of the novel multi-functional hematopoietic agonists wherein at least one of the with the DNA sequence of the other colony stimulating factor may be accomplished by the use of intermediate vectors. Alternatively one gene can be cloned directly into a vector containing the other gene. Linkers and adapters can be used for joining the DNA sequences, as well as replacing lost sequences, where a restriction site was internal to the region of interest. Thus genetic material (DNA) encoding one polypeptide, peptide linker, and the other polypeptide is inserted into a suitable expression vector which is used to transform bacteria, yeast, insect cells or mammalian cells. The transformed organism is grown and the protein isolated by standard techniques. The resulting product is therefore a new protein which has a colony stimulating factor joined by a linker region to a second colony stimulating factor.

Another aspect of the present invention provides plasmid DNA vectors for use in the expression of these novel multi-functional chimeric hematopoietic receptor agonists. These vectors contain the novel DNA sequences described above which code for the novel polypeptides of the invention. Appropriate vectors which can transform microorganisms capable of expressing the multi-functional chimeric hematopoietic receptor agonists include expression vectors comprising nucleotide sequences coding for the multi-functional chimeric hematopoietic receptor agonists joined to transcriptional and translational regulatory sequences which are selected according to the host cells used.

Vectors incorporating modified sequences as described above are included in the present invention and are useful in the production of the multi-functional chimeric hematopoietic receptor agonist polypeptides. The vector employed in the method also contains selected regulatory sequences in operative association with the DNA coding sequences of the invention and which are capable of directing the replication and expression thereof in selected host cells.

As another aspect of the present invention, there is provided a method for producing the novel multi-functional chimeric hematopoietic receptor agonists. The method of the present invention involves culturing suitable cells or cell line, which has been transformed with a vector containing a DNA sequence coding for expression of a novel multi-functional chimeric hematopoietic receptor agonist. Suitable cells or cell lines may be bacterial cells. For example, the various strains of *E. coli* are well-known as host cells in the field of biotechnology. Examples of such strains include *E. coli* strains JM101 (Yanish-Perron et al. *Gene* 33: 103–119, 1985) and MON105 (Obukowicz et al., *Applied Environmental Microbiology* 58: 1511–1523, 1992). Also included in the present invention is the expression of the multi-functional chimeric hematopoietic receptor agonist protein utilizing a chromosomal expression vector for *E. coli* based on the bacteriophage Mu (Weinberg et al., *Gene* 126: 25–33, 1993). Various strains of *B. subtilis* may also be employed in this method. Many strains of yeast cells known to those skilled in the art are also available as host cells for expression of the polypeptides of the present invention. When expressed in the *E. coli* cytoplasm, the gene encoding the multi-functional chimeric hematopoietic receptor agonists of the present invention may also be constructed such that at the 5' end of the gene codons are added to encode $Met^{-2}$-$Ala^{-1}$- or $Met^{-1}$ at the N-terminus of the protein. The N termini of proteins made in the cytoplasm of *E. coli* are affected by post-translational processing by methionine aminopeptidase (Ben Bassat et al., *J. Bac.* 169:751–757, 1987) and possibly by other peptidases so that upon expression the methionine is cleaved off the N-terminus. The multi-functional chimeric hematopoietic receptor agonists of the present invention may include multi-functional chimeric hematopoietic receptor agonist polypeptides having $Met^{-1}$, $Ala^{-1}$ or $Met^{-2}$-$Ala^{-1}$ at the N-terminus. These mutant multi-functional chimeric hematopoietic receptor agonists may also be expressed in *E. coli* by fusing a secretion signal peptide to the N-terminus. This signal peptide is cleaved from the polypeptide as part of the secretion process. Additional strategies for achieving high-level expression of genes in *E. coli* can be found in Savvas, C. M. (*Microbiological Reviews* 60; 512–538, 1996).

Also suitable for use in the present invention are mammalian cells, such as Chinese hamster ovary cells (CHO). General methods for expression of foreign genes in mammalian cells are reviewed in Kaufman, R. J., 1987) Genetic Engineering, Principles and Methods, Vol. 9, J. K. Setlow, editor, Plenum Press, New York. An expression vector is constructed in which a strong promoter capable of functioning in mammalian cells drives transcription of a eukaryotic secretion signal peptide coding region, which is translationally joined to the coding region for the multi-functional chimeric hematopoietic receptor agonist. For example, plasmids such as pcDNA I/Neo, pRc/RSV, and pRc/CMV (obtained from Invitrogen Corp., San Diego, Calif.) can be used. The eukaryotic secretion signal peptide coding region can be from the gene itself or it can be from another secreted mammalian protein (Bayne, M. L. et al., *Proc. Natl. Acad. Sci. USA* 84: 2638–2642, 1987). After construction of the vector containing the gene, the vector DNA is transfected into mammalian cells. Such cells can be, for example, the COS7, HeLa, BHK, CHO, or mouse L lines. The cells can be cultured, for example, in DMEM media (JRH Scientific). The polypeptide secreted into the media can be recovered by standard biochemical approaches following transient expression for 24–72 hours after transfection of the cells or after establishment of stable cell lines following selection for antibiotic resistance. The selection of suitable mammalian host cells and methods for transformation, culture, amplification, screening and product production and purification are known in the art. See, e.g., Gething and Sambrook, *Nature,* 293:620–625, 1981), or alternatively, Kaufman et al, *Mol. Cell. Biol.,* 5(7):1750–1759, 1985) or Howley et al., U.S. Pat. No. 4,419,446. Another suitable mammalian cell line is the monkey COS-1 cell line. A similarly useful mammalian cell line is the CV-1 cell line.

Where desired, insect cells may be utilized as host cells in the method of the present invention. See, e.g., Miller et al., *Genetic Engineering,* 8:277–298 (Plenum Press 1986) and references cited therein. In addition, general methods for expression of foreign genes in insect cells using *Baculovirus* vectors are described in: Summers, M. D. and Smith, G. E., 1987)—A manual of methods for Baculovirus vectors and insect cell culture procedures, Texas Agricultural Experiment Station Bulletin No. 1555. An expression vector is constructed comprising a Baculovirus transfer vector, in which a strong Baculovirus promoter (such as the polyhedron promoter) drives transcription of a eukaryotic secretion signal peptide coding region, which is translationally joined to the coding region for the multi-functional chimeric hematopoietic receptor agonist polypeptide. For example, the plasmid pVL1392 (obtained from Invitrogen Corp., San Diego, Calif. can be used. After construction of the vector carrying the gene encoding the multi-functional chimeric hematopoietic receptor agonist polypeptide, two micrograms of this DNA is co-transfected with one microgram of Baculovirus DNA (see Summers & Smith, 1987) into insect cells, strain SF9. Pure recombinant Baculovirus carrying the multi-functional chimeric hematopoietic receptor agonist is used to infect cells cultured, for example, in Excell 401 serum-free medium (JRH Biosciences, Lenexa, Kans.). The multi-functional chimeric hematopoietic receptor agonist secreted into the medium can be recovered by standard biochemical approaches. Supernatants from mammalian or insect cells expressing the multi-functional chimeric hematopoietic receptor agonist protein can be first concentrated using any of a number of commercial concentration units.

The multi-functional chimeric hematopoietic receptor agonists of the present invention may be useful in the treatment of diseases characterized by decreased levels of either myeloid, erythroid, lymphoid, or megakaryocyte cells of the hematopoietic system or combinations thereof. In addition, they may be used to activate mature myeloid and/or lymphoid cells. Among conditions susceptible to treatment with the polypeptides of the present invention is leukopenia, a reduction in the number of circulating leukocytes (white cells) in the peripheral blood. Leukopenia may be induced by exposure to certain viruses or to radiation. It is often a side effect of various forms of cancer therapy, e.g., exposure to chemotherapeutic drugs, radiation and of infection or hemorrhage. Therapeutic treatment of leukopenia with these multi-functional chimeric hematopoietic receptor agonists of the present invention may avoid undesirable side effects caused by treatment with presently available drugs.

The multi-functional chimeric hematopoietic receptor agonists of the present invention may be useful in the treatment of neutropenia and, for example, in the treatment of such conditions as aplastic anemia, cyclic neutropenia, idiopathic neutropenia, Chediak-Higashi syndrome, systemic lupus erythematosus (SLE), leukemia, myelodysplastic syndrome and myelofibrosis.

The multi-functional chimeric hematopoietic receptor agonist of the present invention may be useful in the treatment or prevention of thrombocytopenia. Currently the only therapy for thrombocytopenia is platelet transfusion which are costly and carry the significant risks of infection (HIV, HBV) and alloimunization. The multi-functional chimeric hematopoietic receptor agonist may alleviate or diminish the need for platelet transfusion. Severe thrombocytopenia may result from genetic defects such as Fanconi's Anemia, Wiscott-Aldrich, or May Hegglin syndromes. Acquired thrombocytopenia may result from auto- or alloantibodies as in Immune Thrombocytopenia Purpura, Systemic Lupus Erythromatosis, hemolytic anemia, or fetal maternal incompatibility. In addition, splenomegaly, disseminated intravascular coagulation, thrombotic thrombocytopenic purpura, infection or prosthetic heart valves may result in thrombocytopenia. Severe thrombocytopenia may also result from chemotherapy and/or radiation therapy or cancer. Thrombocytopenia may also result from marrow invasion by carcinoma, lymphoma, leukemia or fibrosis.

The multi-functional chimeric hematopoietic receptor agonists of the present invention may be useful in the mobilization of hematopoietic progenitors and stem cells in peripheral blood. Peripheral blood derived progenitors have been shown to be effective in reconstituting patients in the setting of autologous marrow transplantation. Hematopoietic growth factors including G-CSF and GM-CSF have been shown to enhance the number of circulating progenitors and stem cells in the peripheral blood. This has simplified the procedure for peripheral stem cell collection and dramatically decreased the cost of the procedure by decreasing the number of pheresis required. The multi-functional chimeric hematopoietic receptor agonist may be useful in mobilization of stem cells and further enhance the efficacy of peripheral stem cell transplantation.

The multi-functional chimeric hematopoietic receptor agonists of the present invention may also be useful in the ex vivo expansion of hematopoietic progenitors and stem cells. Colony stimulating factors (CSFs), such as hIL-3, have been administered alone, co-administered with other CSFs, or in combination with bone marrow transplants subsequent to high dose chemotherapy to treat the neutropenia and thrombocytopenia which are often the result of such treatment. However the period of severe neutropenia and thrombocytopenia may not be totally eliminated. The myeloid lineage, which is comprised of monocytes (macrophages), granulocytes (including neutrophils) and megakaryocytes, is critical in preventing infections and bleeding which can be life-threatening. Neutropenia and thrombocytopenia may also be the result of disease, genetic disorders, drugs, toxins, radiation and many therapeutic treatments such as conventional oncology therapy.

Bone marrow transplants have been used to treat this patient population. However, several problems are associated with the use of bone marrow to reconstitute a compromised hematopoietic system including: 1) the number of stem cells in bone marrow, spleen, or peripheral blood is limited, 2) Graft Versus Host Disease, 3) graft rejection and 4) possible contamination with tumor cells. Stem cells make up a very small percentage of the nucleated cells in the bone marrow, spleen and peripheral blood. It is clear that a dose response exists such that a greater number of stem cells will enhance hematopoietic recovery. Therefore, the in vitro expansion of stem cells should enhance hematopoietic recovery and patient survival. Bone marrow from an allogeneic donor has been used to provide bone marrow for transplant. However, Graft Versus Host Disease and graft rejection limit bone marrow transplantation even in recipients with HLA-matched sibling donors. An alternative to allogeneic bone marrow transplants is autologous bone marrow transplants. In autologous bone marrow transplants, some of the patient's own marrow is harvested prior to myeloablative therapy, e.g. high dose chemotherapy, and is transplanted back into the patient afterwards. Autologous transplants eliminate the risk of Graft Versus Host Disease and graft rejection. However, autologous bone marrow transplants still present problems in terms of the limited number of stems cells in the marrow and possible contamination with tumor cells. The limited number of stem cells may be overcome by ex-vivo expansion of the stem cells. In addition, stem cells can be specifically isolated, based on the presence of specific surface antigens such as CD34+ in order to decrease tumor cell contamination of the marrow graft.

The following patents contain further details on separating stem cells, CD34+ cells, culturing the cells with hematopoietic factors, the use of the cells for the treatment of patients with hematopoietic disorders and the use of hematopoietic factors for cell expansion and gene therapy.

U.S. Pat. No. 5,061,620 relates to compositions comprising human hematopoietic stem cells provided by separating the stem cells from dedicated cells.

U.S. Pat. No. 5,199,942 describes a method for autologous hematopoietic cell transplantation comprising: (1) obtaining hematopoietic progenitor cells from a patient; (2) ex-vivo expansion of cells with a growth factor selected from the group consisting of IL-3, flt3 ligand, c-kit ligand, GM-CSF, IL-1, GM-CSF/IL-3 fusion protein and combinations thereof; (3) administering cellular preparation to a patient.

U.S. Pat. No. 5,240,856 relates to a cell separator that includes an apparatus for automatically controlling the cell separation process.

WO 91/16116 describes devices and methods for selectively isolating and separating target cells from a mixture of cells.

WO 91/18972 describes methods for in vitro culturing of bone marrow, by incubating suspension of bone marrow cells, using a hollow fiber bioreactor.

WO 92/18615 relates to a process for maintaining and expanding bone marrow cells, in a culture medium containing specific mixtures of cytokines, for use in transplants.

WO 93/08268 describes a method for selectively expanding stem cells, comprising the steps of (a) separating CD34+ stem cells from other cells and (b) incubating the separated cells in a selective medium, such that the stem cells are selectively expanded.

WO 93/18136 describes a process for in vitro support of mammalian cells derived from peripheral blood.

WO 93/18648 relates to a composition comprising human neutrophil precursor cells with a high content of myeloblasts and promyelocytes for treating genetic or acquired neutropenia.

WO 94/08039 describes a method of enrichment for human hematopoietic stem cells by selection for cells which express c-kit protein.

WO 94/11493 describes a stem cell population that are CD34+ and small in size, which are isolated using a counterflow elutriation method.

WO 94/27698 relates to a method combining immunoaffinity separation and continuous flow centrifugal separation for the selective separation of a nucleated heterogeneous cell population from a heterogeneous cell mixture.

WO 94/25848 describes a cell separation apparatus for collection and manipulation of target cells.

The long term culturing of highly enriched CD34+ precursors of hematopoietic progenitor cells from human bone marrow in cultures containing IL-1a, IL-3, IL-6 or GM-CSF is discussed in Brandt et al *J. Clin. Invest.* 86:932–941, 1990).

One aspect of the present invention provides a method for selective ex-vivo expansion of stem cells. The term "stem cell" refers to the totipotent hematopoietic stem cells as well as early precursors and progenitor cells which can be isolated from bone marrow, spleen or peripheral blood. The term "expansion" refers to the differentiation and proliferation of the cells. The present invention provides a method for selective ex-vivo expansion of stem cells, comprising the steps of: (a) separating stem cells from other cells, (b) culturing said separated stem cells with a selective media which contains multi-functional chimeric hematopoietic receptor agonist protein(s) and (c) harvesting said stems cells. Stem cells, as well as committed progenitor cells destined to become neutrophils, erythrocytes, platelets, etc. may be distinguished from most other cells by the presence or absence of particular progenitor marker antigens, such as CD34, that are present on the surface of these cells and/or by morphological characteristics. The phenotype for a highly enriched human stem cell fraction is reported as CD34+, Thy-1+ and lin-, but it is to be understood that the present invention is not limited to the expansion of this stem cell population. The CD34+ enriched human stem cell fraction can be separated by a number of reported methods, including affinity columns or beads, magnetic beads or flow cytometry using antibodies directed to surface antigens such as the CD34+. Further, physical separation methods such as counterflow elutriation may be used to enrich hematopoietic progenitors. The CD34+ progenitors are heterogeneous, and may be divided into several sub-populations characterized by the presence or absence of co-expression of different lineage associated cell surface associated molecules. The most immature progenitor cells do not express any known lineage associated markers, such as HLA-DR or CD38, but they may 10 express CD90(thy-1). Other surface antigens such as CD33, CD38, CD41, CD71, HLA-DR or c-kit can also be used to selectively isolate hematopoietic progenitors. The separated cells can be incubated in selected medium in a culture flask, sterile bag or in hollow fibers. Various colony stimulating factors may be utilized in order to selectively expand cells. Representative factors that have been utilized for ex-vivo expansion of bone marrow include, c-kit ligand, IL-3, G-CSF, GM-CSF, IL-1, IL-6, IL-11, flt-3 ligand or combinations thereof. The proliferation of the stem cells can be monitored by enumerating the number of stem cells and other cells, by standard techniques (e.g. hemacytometer, CFU, LTCIC) or by flow cytometry prior and subsequent to incubation.

Several methods for ex-vivo expansion of stem cells have been reported utilizing a number of selection methods and expansion using various colony stimulating factors including c-kit ligand (Brandt et al., *Blood* 83:1507–1514 [1994], McKenna et al., *Blood* 86:3413–3420 [1995]), IL-3 (Brandt et al., *Blood* 83:1507–1514 [1994], Sato et al., *Blood* 82:3600–3609 [1993]), G-CSF (Sato et al., *Blood* 82:3600–3609 [1993]), GM-CSF (Sato et al., *Blood* 82:3600–3609 [1993]), IL-1 (Muench et al., *Blood* *81:3463–3473 [1993]*), IL-6 (Sato et al., *Blood* 82:3600–3609 [1993]), IL-11 (Lemoli et al., *Exp. Hem.* 21:1668–1672 [1993], Sato et al., *Blood* 82:3600–3609 [1993]), flt-3 ligand (McKenna et al., *Blood* 86:3413 3420 [1995]) and/or combinations thereof (Brandt et al., *Blood* 83:1507 1514 [1994], Haylock et al., *Blood* 80:1405–1412 [1992], Koller et al., *Biotechnology* 11:358–363 [1993], (Lemoli et al., *Exp. Hem.* 21:1668–1672 [1993]), McKenna et al., *Blood* 86:3413–3420 [1995], Muench et al., *Blood* 81:3463–3473 [1993], Patchen et al., *Biotherapy* 7:13–26 [1994], Sato et al., *Blood* 82:3600–3609 [1993], Smith et al., *Exp. Hem.* 21:870–877 [1993], Steen et al., *Stem Cells* 12:214–224 [1994], Tsujino et al., *Exp. Hem.* 21:1379–1386 [1993]). Among the individual colony stimulating factors, hIL-3 has been shown to be one of the most potent in expanding peripheral blood CD34+ cells (Sato et al., *Blood* 82:3600–3609 [1993], Kobayashi et al., *Blood* 73:1836–1841 [1989]). However, no single factor has been shown to be as effective as the combination of multiple factors. The present invention provides methods for ex vivo expansion that utilize multi-functional chimeric hematopoietic receptor agonists that are more effective than a single factor alone.

Another aspect of. the invention provides methods of sustaining and/or expanding hematopoietic precursor cells which includes inoculating the cells into a culture vessel which contains a culture medium that has been conditioned by exposure to a stromal cell line such as HS-5 (WO 96/02662, Roecklein and Torok-Strob, *Blood* 85:997–1105, 1995) that has been supplemented with a multi-functional hematopoietic chimeric receptor agonist of the present invention.

It is also envisioned that uses of multi-functional hematopoietic chimeric receptor agonists of the present invention would include blood banking applications, where the EPO receptor agonists are given to a patent to increase the number of blood cells and blood products are removed from the patient, prior to some medical procedure. The blood products stored and transfused back into the patient after the medical procedure. Additionally, it is envisioned that uses of multi-functional hematopoietic chimeric receptor agonists would include giving the multi-functional hematopoietic chimeric receptor agonists to a blood donor prior to blood donation to increase the number of blood cells, thereby allowing the donor to safely give more blood.

Another projected clinical use of growth factors has been in the in vitro activation of hematopoietic progenitors and stem cells for gene therapy. Due to the long life-span of hematopoietic progenitor cells and the distribution of their daughter cells throughout the entire body, hematopoietic progenitor cells are good candidates for ex vivo gene transfection. In order to have the gene of interest incorporated into the genome of the hematopoietic progenitor or stem cell one needs to stimulate cell division and DNA replication. Hematopoietic stem cells cycle at a very low frequency which means that growth factors may be useful to promote gene transduction and thereby enhance the clinical prospects for gene therapy. Potential applications of gene therapy (review Crystal, *Science* 270:404–410 [1995]) include; 1) the treatment of many congenital metabolic disorders and immunodeficiencies (Kay and Woo, *Trends Genet.* 10:253–257 [1994]), 2) neurological disorders (Friedmann, *Trends Genet.* 10:210–214 [1994]), 3) cancer (Culver and Blaese, *Trends Genet.* 10:174–178 [1994]) and 4) infectious diseases (Gilboa and Smith, *Trends Genet.* 10:139–144 [1994]).

There are a variety of methods, known to those with skill in the art, for introducing genetic material into a host cell. A number of vectors, both viral and non-viral have been developed for transferring therapeutic genes into primary cells. Viral based vectors include; 1) replication deficient recombinant retrovirus (Boris-Lawrie and Temin, *Curr. Opin. Genet. Dev.* 3:102–109 [1993], Boris-Lawrie and Temin, *Annal. New York Acad. Sci.* 716:59–71 [1994], Miller, *Current Top. Microbiol. Immunol.* 158:1–24 [1992]) and replication-deficient recombinant adenovirus (Berkner, *BioTechniques* 6:616–629 [1988], Berkner, *Current Top. Microbiol. Immunol.* 158:39–66 [1992], Brody and Crystal, *Annal. New York Acad. Sci.* 716:90–103 [1994]). Non-viral based vectors include protein/DNA complexes (Cristiano et al., *PNAS USA.* 90:2122–2126 [1993], Curiel et al., *PNAS USA* 88:8850–8854 [1991], Curiel, *Annal. New York Acad. Sci.* 716:36–58 [1994]), electroporation and liposome mediated delivery such as cationic liposomes (Farhood et al., *Annal. New York Acad. Sci.* 716:23–35 [1994]).

The present invention provides an improvement to the existing methods of expanding hematopoietic cells, which new genetic material has been introduced, in that it provides methods utilizing multi-functional chimeric hematopoietic receptor agonist proteins that have improved biological activity, including an activity not seen by any single colony stimulation factor.

Many drugs may cause bone marrow suppression or hematopoietic deficiencies. Examples of such drugs are AZT, DDI, alkylating agents and anti-metabolites used in chemotherapy, antibiotics such as chloramphenicol, penicillin, gancyclovir, daunomycin and sulfa drugs, phenothiazones, tranquilizers such as meprobamate, analgesics such as aminopyrine and dipyrone, anti-convulsants such as phenytoin or carbamazepine, antithyroids such as propylthiouracil and methimazole and diuretics. The multi-functional chimeric hematopoietic receptor agonists of the present invention may be useful in preventing or treating the bone marrow suppression or hematopoietic deficiencies which often occur in patients treated with these drugs.

Hematopoietic deficiencies may also occur as a result of viral, microbial or parasitic infections, burns and as a result of treatment for renal disease or renal failure, e.g., dialysis. The multi-functional chimeric hematopoietic receptor agonists of the present invention may be useful in treating such hematopoietic deficiencies.

The treatment of hematopoietic deficiency may include administration of a pharmaceutical composition containing the multi-functional chimeric hematopoietic receptor agonists to a patient. The multi-functional chimeric hematopoietic receptor agonists of the present invention may also be useful for the activation and amplification of hematopoietic precursor cells by treating these cells in vitro with the multi-functional chimeric hematopoietic receptor agonist proteins of the present invention prior to injecting the cells into a patient.

Various immunodeficiencies, e.g., in T and/or B lymphocytes, or immune disorders, e.g., rheumatoid arthritis, may also be beneficially affected by treatment with the multi-functional chimeric hematopoietic receptor agonists of the present invention. Immunodeficiencies may be the result of viral infections, e.g., HTLVI, HTLVII, HTLVIII, severe exposure to radiation, cancer therapy or the result of other medical treatment. The multi-functional chimeric hematopoietic receptor agonists of the present invention may also be employed, alone or in combination with other colony stimulating factors, in the treatment of other blood cell deficiencies, including thrombocytopenia (platelet deficiency), or anemia. Other uses for these novel polypeptides are the in vivo and ex vivo treatment of patients recovering from bone marrow transplants, and in the development of monoclonal and polyclonal antibodies generated by standard methods for diagnostic or therapeutic use.

Other aspects of the present invention are methods and therapeutic compositions for treating the conditions referred to above. Such compositions comprise a therapeutically effective amount of one or more of the multi-functional chimeric hematopoietic receptor agonists of the present invention in a mixture with a pharmaceutically acceptable carrier. This composition can be administered either parenterally, intravenously or subcutaneously. When administered, the therapeutic composition for use in this invention is preferably in the form of a pyrogen-free, parenterally acceptable aqueous solution. The preparation of such a parenterally acceptable protein solution, having due regard to pH, isotonicity, stability and the like, is within the skill of the art.

Another intended use of the multi-functional chimeric hematopoietic receptor agonists of the present invention is for the generation of larger numbers of dendritic cells, from precursors, to be used as adjuvants for immunization. Dendritic cells play a crucial role in the immune system. They are the professional antigen-presenting cells most efficient in the activation of resting T cells and are the major antigen-presenting cells for activation of naïve T cells in vivo and, thus, for initiation of primary immune responses. They efficiently internalize, process and present soluble tumor-specific antigens (Ag). Dendritic cells have the unique capacity to cluster naive T cells and to respond to Ag encounter by rapid upregulation of the expression of major histocompatability complex (MHC) and co-stimulatory molecules, the production of cytokines and migration towards lymphatic organs. Since dendritic cells are of central importance for sensitizing the host against a neoantigen for CD4− dependent immune responses, they may also play a crucial role in the generation and regulation of tumor immunity.

Dendritic cells originate from a bone marrow CD34+ precursor common to granulocytes and macrophages, and the existence of a separate dendritic cell colony-forming unit (CFU-DC) that give rise to pure dendritic cell colonies has been established in humans. In addition, a post-CFU CD14+ intermediate has been described with the potential to differentiate along the dendritic cell or the macrophage pathway under distinct cytokine conditions. This bipotential precursor is present in the bone marrow, cord blood and peripheral blood. Dendritic cells can be isolated based on specific cell surface markers, such as CD1a+, CD3−, CD4−, CD20−, CD40+, CD80+, and CD83+, to delineate the maturation of cultured dendritic cells.

Dendritic cells based strategies provide a method for enhancing immune response against tumors and infectious agents. AIDS is another disease for which dendritic cell based therapies can be used, since dendritic cells can play a major role in promoting HIV-1 replication. An immunotherapy requires the generation of dendritic cells from cancer patients, their in vitro exposure to tumor Ag, derived from surgically removed tumor masses, and reinjection of these cells into the tumor patients. Relatively crude membrane preparations of tumor cells will suffice as sources of tumor antigen, avoiding the necessity for molecular identification of the tumor antigen. The tumor antigen may also be synthetic peptides, carbohydrates, or nucleic acid sequences. In addition, concomitant administration of cytokines such as the multi-functional chimeric hematopoietic receptor agonists of the present invention may further facilitate the induction of tumor immunity. It is foreseen that the immunotherapy can be in an in vivo setting, wherein the multi-functional chimeric hematopoietic receptor agonists of the present invention is administered to a patient, having a tumor, alone or with other hematopoietic growth factors to increase the number of dendritic cells and endogenous tumor antigen is presented on the dendritic cells. It is also envisioned that in vivo immunotherapy can be with exogenous antigen. It is also envisioned that the immunotherapy treatment may include the mobilization of dendritic cell precursors or mature dendritic, by administering the multi-functional chimeric hematopoietic receptor agonists of the present invention alone or with other hematopoietic growth factors to the patient, removing the dendritic cell precursors or mature dendritic cells from the patient, exposing the dendritic cells to antigen and returning the dendritic cells to the patient. Furthermore, the dendritic cells that have been removed can be cultured ex vivo with the multi-functional chimeric hematopoietic receptor agonists of the present invention alone or with other hematopoietic growth factors to increase the number of dendritic cells prior to exposure to antigen. Dendritic cells based strategies also provide a method for reducing the immune response in auto-immune diseases.

Studies on dendritic cells have been greatly hampered by difficulties in preparing the cells in sufficient numbers and in a reasonably pure form. In an ex-vivo cell expansion setting, granulocyte-macrophage colony-stimulating factor (GM-CSF) and tumor necrosis factor-α (TNF-α) cooperate in the ex vivo generation of dendritic cells from hematopoietic progenitors (CD34+ cells) retrieved from bone marrow, cord blood, or peripheral blood and flk-2/flt-3 ligand and c-kit ligand (stem cell factor [SCF]) synergize to enhance the GM-CSF plus TNF-α induced generation of dendritic cells (Siena, S. et al. *Experimental Hematology* 23:1463–1471, 1995). Also provide is a method of ex vivo expansion of dendritic cell precursors or mature dendritic cells using the multi-functional chimeric hematopoietic receptor agonists of the present invention to provide sufficient quantities of dendritic cells for immunotherapy.

The dosage regimen involved in a method for treating the above-described conditions will be determined by the attending physician considering various factors which modify the action of drugs, e.g., the condition, body weight, sex and diet of the patient, the severity of any infection, time of administration and other clinical factors. Generally, a daily regimen may be in the range of 0.2–150 μg/kg of multi-functional chimeric hematopoietic receptor agonist protein per kilogram of body weight. Dosages would be adjusted relative to the activity of a given multi-functional chimeric hematopoietic receptor agonist protein and it would not be unreasonable to note that dosage regimens may include doses as low as 0.1 microgram and as high as 1 milligram per kilogram of body weight per day. In addition, there may exist specific circumstances where dosages of multi-functional chimeric hematopoietic receptor agonist would be adjusted higher or lower than the range of 0.2–150 micrograms per kilogram of body weight. These include co-administration with other colony stimulating factors or IL-3 variants or growth factors; co-administration with chemotherapeutic drugs and/or radiation; the use of glycosylated multi-functional chimeric hematopoietic receptor agonist protein; and various patient-related issues mentioned earlier in this section. As indicated above, the therapeutic method and compositions may also include co-administration with other human factors. A non-exclusive list of other appropriate colony stimulating factors (CSFs), cytokines, lymphokines, hematopoietic growth factors and interleukins for simultaneous or serial co-administration with the polypeptides of the present invention includes GM-CSF, G-CSF, c-mpl ligand (also known as TPO or MGDF), M-CSF, erythropoietin (EPO), IL-1, IL-4, IL-2, IL-3, IL-5, IL-6, IL-7, IL-8, IL-9, IL-10, IL-11, IL-12, IL-13, IL-15, IL-16, LIF, flt3/flk2 ligand, B-cell growth factor, B-cell differentiation factor and eosinophil differentiation factor, stem cell factor (SCF) also known as steel factor or c-kit ligand, or combinations thereof. The dosage recited above would be adjusted to compensate for such additional components in the therapeutic composition. Progress of the treated patient can be monitored by periodic assessment of the hematological profile, e.g., differential cell count and the like.

Materials and Methods

Unless noted otherwise, all specialty chemicals were obtained from Sigma, Co. (St. Louis, Mo.). Restriction endonucleases and T4 DNA ligase were obtained from New England Biolabs (Beverly, Mass.) or Boehringer Mannheim (Indianapolis, Ind.).

Transformation of *E. coli* Strains

*E. coli* strains, such as DH5a™ (Life Technologies, Gaithersburg, Md.) and TG1 (Amersham Corp., Arlington Heights, Ill.) are used for transformation of ligation reactions and are the source of plasmid DNA for transfecting mammalian cells. *E. coli* strains, such as JM101 (Yanisch-Perron, et al., *Gene*, 33: 103–119, 1985) and MON105 (Obukowicz, et al., *Appl. and Envir. Micr.*, 58: 1511–1523, 1992) can be used for expressing the multi-functional chimeric hematopoietic receptor agonist of the present invention in the cytoplasm or periplasmic space.

MON105 ATCC#55204: F-, lambda-, IN(rrnD, rrE)1, rpoD+, rpoH358

DH5a™: F-, phi80dlacZdeltaM15, delta(lacZYA-argF) U169, deoR, recA1, endA1, hsdR17(rk-, mk+), phoA, supE44lamda-, thi-1, gyrA96, relA1

TG1: delta(lac-pro), supE, thi-1, hsdD5/F'(traD36, proA+B+, lacIq, lacZdeltaM15)

JM101 ATCC#33876: delta (pro lac), supe, thi, F'(traD36, proA+B+, lacIq, lacZdeltaM15)

DH5a™ Subcloning efficiency cells are purchased as competent cells and are ready for transformation using the manufacturer's protocol, while both *E. coli* strains TG1 and MON105 are rendered competent to take up DNA using a $CaCl_2$ method. Typically, 20 to 50 mL of cells are grown in LB medium (1% Bacto-tryptone, 0.5% Bacto-yeast extract, 150 mM NaCl) to a density of approximately 1.0 optical density unit at 600 nanometers (OD600) as measured by a Baush & Lomb Spectronic spectrophotometer (Rochester, N.Y.). The cells are collected by centrifugation and resuspended in one-fifth culture volume of $CaCl_2$ solution (50 mM $CaCl_2$, 10 mM Tris-Cl, pH7.4) and are held at 4° C. for 30 minutes. The cells are again collected by centrifugation and resuspended in one-tenth culture volume of $CaCl_2$ solution. Ligated DNA is added to 0.2 mL of these cells, and the samples are held at 4° C. for 30–60 minutes. The samples are shifted to 42° C. for two minutes and 1.0 mL of LB is added prior to shaking the samples at 37° C. for one hour. Cells from these samples are spread on plates (LB medium plus 1.5% Bacto-agar) containing either ampicillin (100 micrograms/mL, ug/mL) when selecting for ampicillin-resistant transformants, or spectinomycin (75 ug/mL) when selecting for spectinomycin-resistant transformants. The plates are incubated overnight at 37° C. Colonies are picked and inoculated into LB plus appropriate antibiotic (100 ug/mL ampicillin or 75 ug/mL spectinomycin) and are grown at 37° C. while shaking.

Methods for Creation of Genes with New N-Terminus/C-Terminus

Method I. Creation of Genes with New N-Terminus/C-Terminus which Contain a Linker Region ($L_2$).

Figure 2:
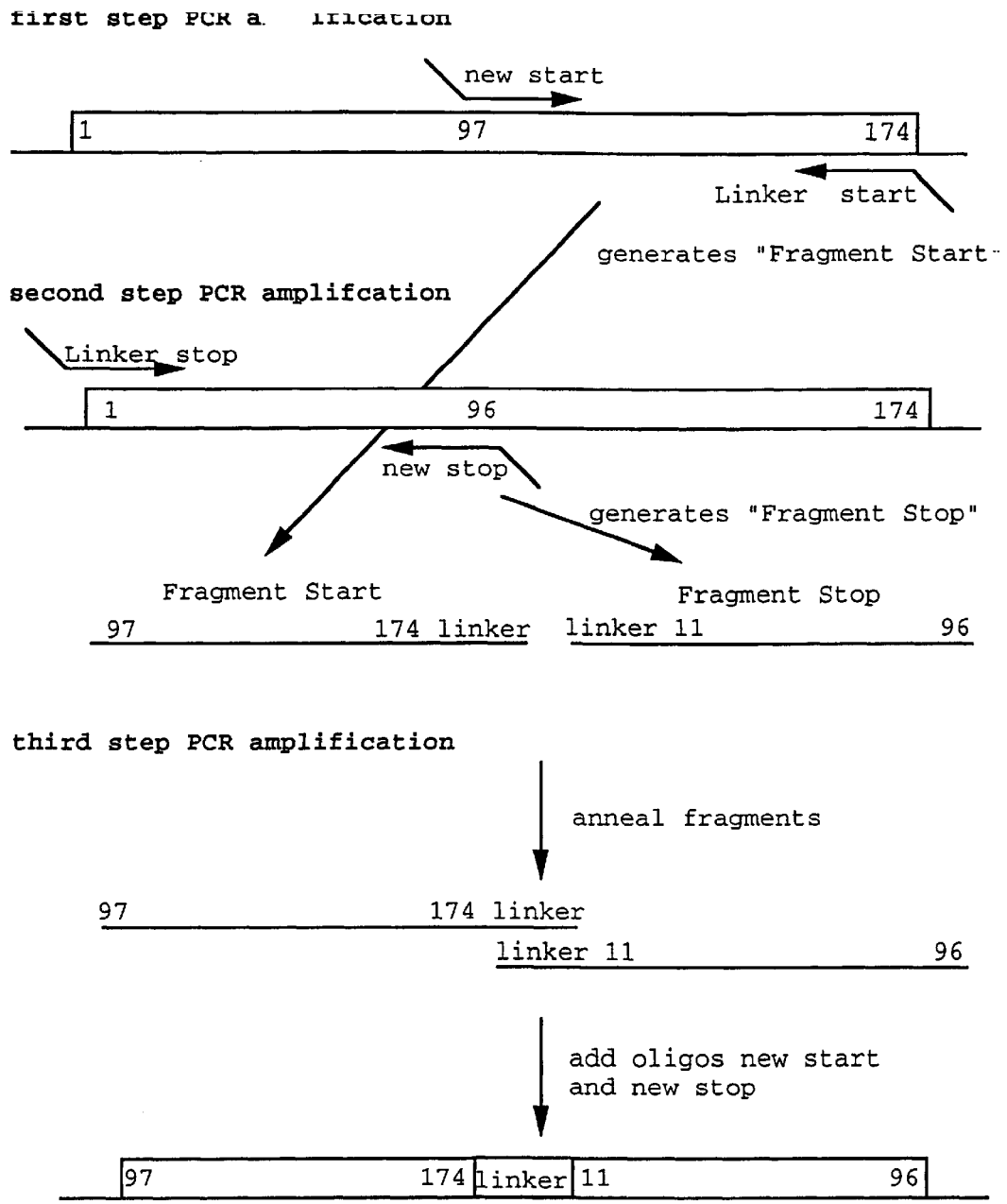
FIG. 2 shows a schematic of Method I, for creating new proteins in which the original N-terminus and C-terminus of the native protein are joined with a linker and different N-terminus and C-terminus of the protein are created. In the example shown the sequence rearrangement results in a new gene encoding a protein with a new N-terminus created at amino acid 97 of the original protein, the original C-terminus (a.a. 174) joined to the amino acid 11 (a.a. 1–10 are deleted) through a linker region and a new C-terminus created at amino acid 96 of the original sequence.

Genes with new N-terminus/C-terminus which contain a linker region ($L_2$) separating the original C-terminus and N-terminus can be made essentially following the method described in L. S. Mullins, et al (*J. Am. Chem. Soc.* 116, 5529–5533, 1994). Multiple steps of polymerase chain reaction (PCR) amplifications are used to rearrange the DNA sequence encoding the primary amino acid sequence of the protein. The steps are illustrated in FIG. 2.

In the first step, the first primer set ("new start" and "linker start") is used to create and amplify, from the original gene sequence, the DNA fragment ("Fragment Start") that contains the sequence encoding the new N-terminal portion of the new protein followed by the linker ($L_2$) that connects the C-terminal and N-terminal ends of the original protein. In the second step, the second primer set ("new stop" and "linker stop") is used to create and amplify, from the original gene sequence, the DNA fragment ("Fragment Stop") that encodes the same linker as used above, followed by the new C-terminal portion of the new protein. The "new start" and "new stop" primers are designed to include the appropriate restriction sites which allow cloning of the new gene into expression plasmids. Typical PCR conditions are one cycle 95° C. melting for two minutes; 25 cycles 94° C. denaturation for one minute, 50° C. annealing for one minute and 72° C., extension for one minute; plus one cycle 72° C. extension for seven minutes. A Perkin Elmer GeneAmp PCR Core Reagents kit is used. A 100 ul reaction contains 100 pmole of each primer and one ug of template DNA; and 1×PCR buffer, 200 uM dGTP, 200 uM dATP, 200 uM dTTP, 200 uM dCTP, 2.5 units AmpliTaq DNA polymerase and 2 mM MgCl2. PCR reactions are performed in a Model 480 DNA thermal cycler (Perkin Elmer Corporation, Norwalk, Conn.).

"Fragment Start" and "Fragment Stop", which have complementary sequence in the linker region and the coding sequence for the two amino acids on both sides of the linker, are joined together in a third PCR step to make the full-length gene encoding the new protein. The DNA fragments "Fragment Start" and "Fragment Stop" are resolved on a 1% TAE gel, stained with ethidium bromide and isolated using a Qiaex Gel Extraction kit (Qiagen). These fragments are combined in equimolar quantities, heated at 70° C. for ten minutes and slow cooled to allow annealing through their shared sequence in "linker start" and "linker stop". In the third PCR step, primers "new start" and "new stop" are added to the annealed fragments to create and amplify the full-length new N-terminus/C-terminus gene. Typical PCR conditions are one cycle 95° C. melting for two minutes; 25 cycles 94° C. denaturation for one minute, 60° C. annealing for one minute and 72° C. extension for one minute; plus one cycle 72° C. extension for seven minutes. A Perkin Elmer GeneAmp PCR Core Reagents kit is used. A 100 ul reaction contains 100 pmole of each primer and approximately 0.5 ug of DNA; and 1×PCR buffer, 200 uM dGTP, 200 uM dATP, 200 uM dTTP, 200 uM dCTP, 2.5 units AmpliTaq DNA polymerase and 2 mM MgCl$_2$. PCR reactions are purified using a Wizard PCR Preps kit (Promega).

Method II. Creation of Genes with New N-Terminus/C-Terminus without a linker Region.

Figure 3:
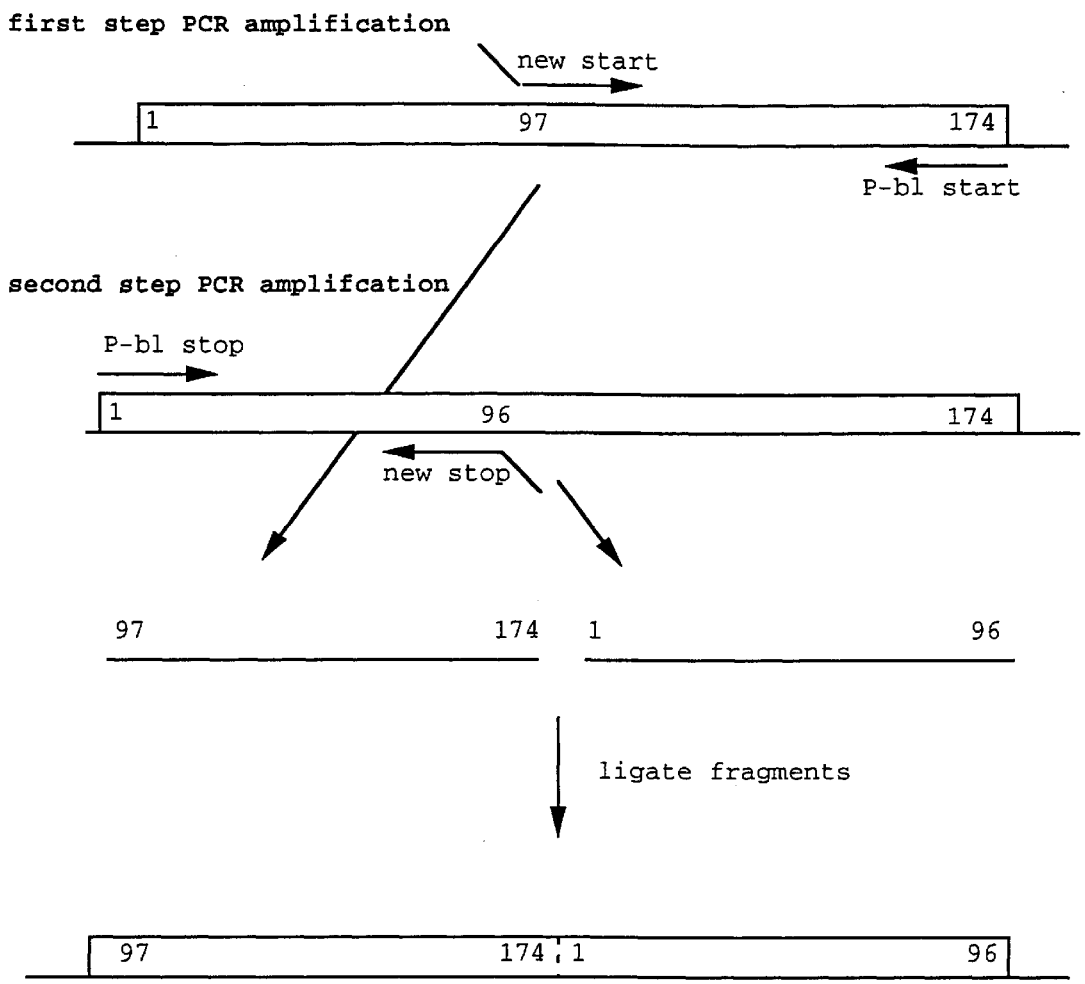
FIG. 3 shows a schematic of Method II, for creating new proteins in which the original N-terminus and C-terminus of the native protein are joined without a linker and different N-terminus and C-terminus of the protein are created. In the example shown the sequence rearrangement results in a new gene encoding a protein with a new N-terminus created at amino acid 97 of the original protein, the original C-terminus (a.a. 174) joined to the original N-terminus and a new C-terminus created at amino acid 96 of the original sequence.
Figure 4:
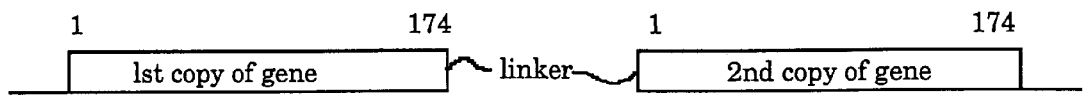
FIG. 4 shows a schematic of Method III, for creating new proteins in which the original N-terminus and C-terminus of the native protein are joined with a linker and different N-terminus and C-terminus of the protein are created. In the example shown the sequence rearrangement results in a new gene encoding a protein with a new N-terminus created at amino acid 97 of the original protein, the original C-terminus (a.a. 174) joined to amino acid 1 through a linker region and a new C-terminus created at amino acid 96 of the original sequence.
Figure 4:
Figure 4:
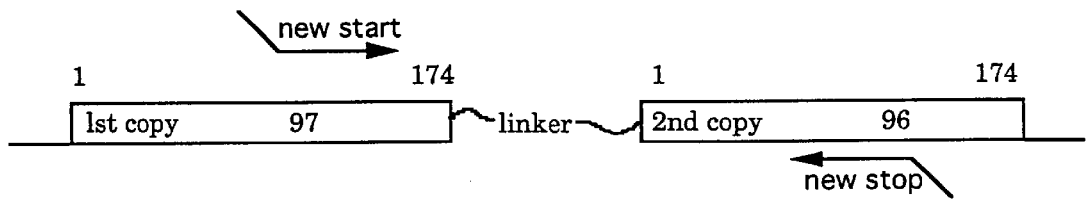
Figure 4:
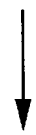
Figure 4:
Figure 5:
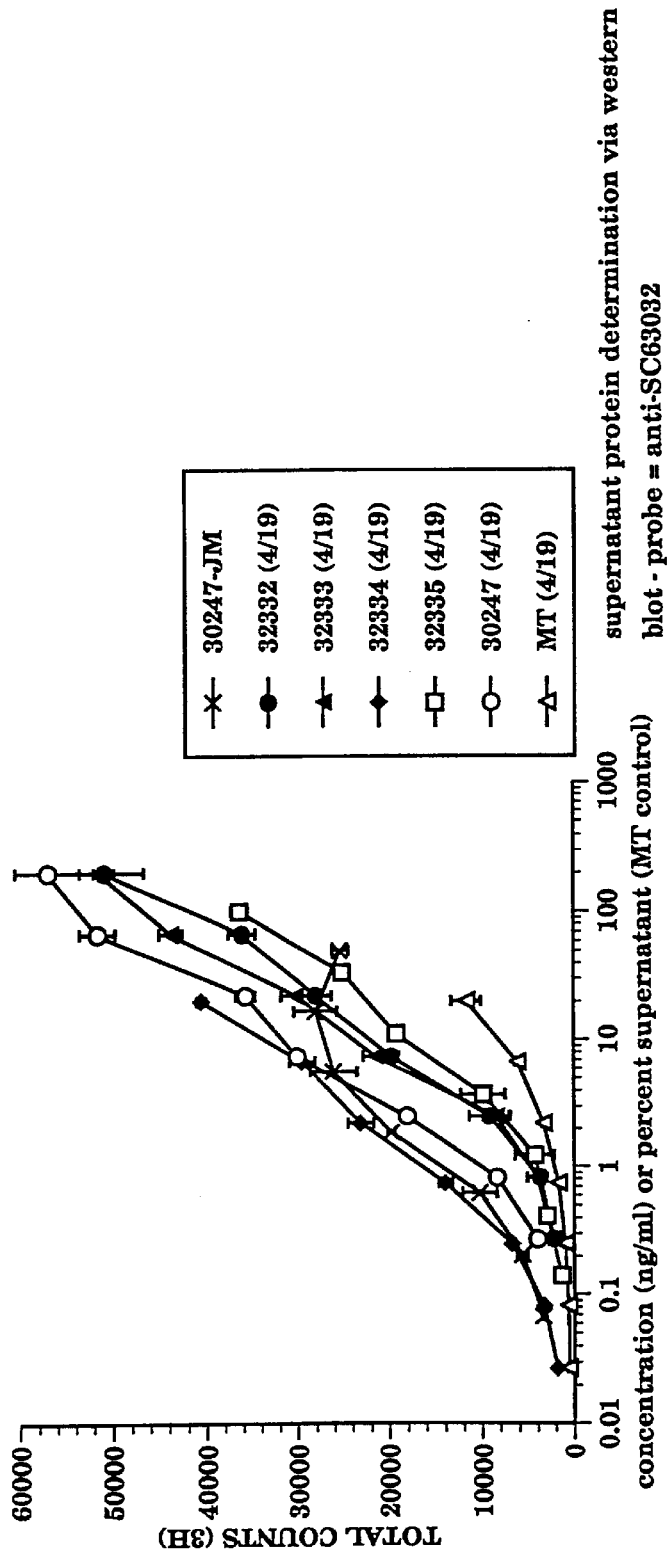
FIG. 5 shows the bioactivity of the multi-functional receptor agonists comprising flt3 receptor agonists pMON32332, pMON32333, pMON32334 and pMON32335 compared to recombinant native flt3 (Genzyme) in the MUTZ-2 cell proliferation assay. MT mock transfection

New N-terminus/C-terminus genes without a linker joining the original N-terminus and C-terminus can be made using two steps of PCR amplification and a blunt end ligation. The steps are illustrated in FIG. 3. In the first step, the primer set ("new start" and "P-bl start") is used to create and amplify, from the original gene sequence, the DNA fragment ("Fragment Start") that contains the sequence encoding the new N-terminal portion of the new protein. In the second step, the primer set ("new stop" and "P-bl stop") is used to create and amplify, from gene sequence, the DNA fragment ("Fragment Stop") that contains the sequence encoding the new C-terminal portion of the new protein. The "new start" and "new stop" primers are designed to include appropriate restriction sites which allow cloning of the new gene into expression vectors. Typical PCR conditions are one cycle 95° C. melting for two minutes; 25 cycles 94° C. denaturation for one minute, 50° C. annealing for 45 seconds and 72° C. extension for 45 seconds. Deep Vent polymerase (New England Biolabs) is used to reduce the occurrence of overhangs in conditions recommended by the manufacturer. The "P-bl start" and "P-bl stop" primers are phosphorylated at the 5' end to aid in the subsequent blunt end ligation of "Fragment Start" and "Fragment Stop" to each other. A 100 ul reaction contained 150 pmole of each primer and one ug of template DNA; and 1× Vent buffer (New England Biolabs), 300 uM dGTP, 300 uM dATP, 300 uM dTTP, 300 uM dCTP, and 1 unit Deep Vent polymerase. PCR reactions are performed in a Model 480 DNA thermal cycler (Perkin Elmer Corporation, Norwalk, Conn.). PCR reaction products are purified using a Wizard PCR Preps kit (Promega).

The primers are designed to include appropriate restriction sites which allow for the cloning of the new gene into expression vectors. Typically "Fragment Start" is designed to create NcoI restriction site, and "Fragment Stop" is designed to create a HindIII restriction site. Restriction digest reactions are purified using a Magic DNA Clean-up System kit (Promega). Fragments Start and Stop are resolved on a 1% TAE gel, stained with ethidium bromide and isolated using a Qiaex Gel Extraction kit (Qiagen). These fragments are combined with and annealed to the ends of the ~3800 base pair NcoI/HindIII vector fragment of pMON3934 by heating at 50° C. for ten minutes and allowed to slow cool. The three fragments are ligated together using T4 DNA ligase (Boehringer Mannheim). The result is a plasmid containing the full-length new N-terminus/C-terminus gene. A portion of the ligation reaction is used to transform E. coli strain DH5α cells (Life Technologies, Gaithersburg, Md). Plasmid DNA is purified and sequence confirmed as below.

Method III. Creation of New N-Terminus/C-Terminus Genes by Tandem-Duplication Method New N-terminus/C-terminus genes can be made based on the method described in R. A. Horlick, et al Protein Eng. 5:427–431, 1992). Polymerase chain reaction (PCR) amplification of the new N-terminus/C-terminus genes is performed using a tandemly duplicated template DNA. The steps are illustrated in FIG. 3.

The tandemly-duplicated template DNA is created by cloning and contains two copies of the gene separated by DNA sequence encoding a linker connecting the original C- and N-terminal ends of the two copies of the gene. Specific primer sets are used to create and amplify a full-length new N terminus/C-terminus gene from the tandemly-duplicated template DNA. These primers are designed to include appropriate restriction sites which allow for the cloning of the new gene into expression vectors. Typical PCR conditions are one cycle 95° C. melting for two minutes; 25 cycles 94° C. denaturation for one minute, 50° C. annealing for one minute and 72° C. extension for one minute; plus one cycle 72° C. extension for seven minutes. A Perkin Elmer GeneAmp PCR Core eagents kit (Perkin Elmer Corporation, Norwalk, Conn.) is sed. A 100 ul reaction contains 100 pmole of each primer and one ug of template DNA; and 1×PCR buffer, 200 uM dGTP, 200 uM dATP, 200 uM dTTP, 200 uM dCTP, 2.5 units AmpliTaq DNA polymerase and 2 mM MgCl$_2$. PCR reactions are performed in a Model 480 DNA thermal cycler (Perkin Elmer Corporation, Norwalk, Conn.). PCR reactions are purified using a Wizard PCR Preps kit (Promega).

Cloning of New N-Terminus/C-Terminus Genes into Multi-Functional Receptor Agonist Expression Vectors.

The new N-terminus/C-terminus gene is digested with restriction endonucleases to create ends that are compatible to insertion into an expression vector containing another colony stimulating factor gene. This expression vector is likewise digested with restriction endonucleases to form compatible ends. After purification, the gene and the vector DNAs are combined and ligated using T4 DNA ligase. A portion of the ligation reaction is used to transform E. coli. Plasmid DNA is purified and sequenced to confirm the correct insert. The correct clones are grown for protein expression.

DNA Isolation and Characterization

Plasmid DNA can be isolated by a number of different methods and using commercially available kits known to those skilled in the art. A few such methods are shown herein. Plasmid DNA is isolated using the Promega Wizard™ Miniprep kit (Madison, Wis.), the Qiagen QIAwell Plasmid isolation kits (Chatsworth, Calif.) or Qiagen Plasmid Midi kit. These kits follow the same general procedure for plasmid DNA isolation. Briefly, cells are pelleted by centrifugation (5000×g), plasmid DNA released with sequential NaOH/acid treatment, and cellular debris is removed by centrifugation (10000×g). The supernatant (containing the plasmid DNA) is loaded onto a column containing a DNA-binding resin, the column is washed, and plasmid DNA eluted with TE. After screening for the colonies with the plasmid of interest, the E. coli cells are inoculated into 50–100 mLs of LB plus appropriate antibiotic for overnight growth at 37° C. in an air incubator while shaking. The purified plasmid DNA is used for DNA sequencing, further restriction enzyme digestion, additional subcloning of DNA fragments and transfection into mammalian, E. coli or other cells.

Sequence Confirmation.

Purified plasmid DNA is resuspended in dH$_2$O and quantitated by measuring the absorbance at 260/280 nm in a Bausch and Lomb Spectronic 601 UV spectrometer. DNA samples are sequenced using ABI PRISM™ DyeDeoxy™ terminator sequencing chemistry (Applied Biosystems Division of Perkin Elmer Corporation, Lincoln City, Calif.) kits (Part Number 401388 or 402078) according to the manufacturers suggested protocol usually modified by the addition of 5% DMSO to the sequencing mixture. Sequencing reactions are performed in a Model 480 DNA thermal cycler (Perkin Elmer Corporation, Norwalk, Conn.) following the recommended amplification conditions. Samples are purified to remove excess dye terminators with Centri-Sep™ spin columns (Princeton Separations, Adelphia, N.J.) and lyophilized. Fluorescent dye labeled sequencing reactions are resuspended in deionized formamide, and sequenced on denaturing 4.75% polyacrylamide-8M urea gels using an ABI Model 373A automated DNA sequencer. Overlapping DNA sequence fragments are analyzed and assembled into master DNA contigs using Sequencher DNA analysis software (Gene Codes Corporation, Ann Arbor, Mich.).

Expression of Multi-Functional Receptor Agonists in Mammalian Cells

Mammalian Cell Transfection/Production of Conditioned Media

The BHK-21 cell line can be obtained from the ATCC (Rockville, Md.). The cells are cultured in Dulbecco's modified Eagle media (DMEM/high-glucose), supplemented to 2 mM (mM) L-glutamine and 10% fetal bovine serum (FBS). This formulation is designated BHK growth media. Selective media is BHK growth media supplemented with 453 units/mL hygromycin B (Calbiochem, San Diego, Calif.). The BHK-21 cell line was previously stably transfected with the HSV transactivating protein VP16, which transactivates the IE110 promoter found on the plasmid pMON3359 (See Hippenmeyer et al., *Bio/Technology*, pp.1037–1041, 1993). The VP16 protein drives expression of genes inserted behind the IE110 promoter. BHK-21 cells expressing the transactivating protein VP16 are designated BHK-VP16. The plasmid pMON1118 (See Highkin et al., *Poultry Sci.*, 70: 970–981, 1991) expresses the hygromycin resistance gene from the SV40 promoter. A similar plasmid is available from ATCC, pSV2-hph.

BHK-VP16 cells are seeded into a 60 millimeter (mm) tissue culture dish at 3×10$^5$ cells per dish 24 hours prior to transfection. Cells are transfected for 16 hours in 3 mL of "OPTIMEM"™ (Gibco-BRL, Gaithersburg, Md.) containing 10 ug of plasmid DNA containing the gene of interest, 3 ug hygromycin resistance plasmid, pMON1118, and 80 ug of Gibco-BRL "LIPOFECTAMINE"™ per dish. The media is subsequently aspirated and replaced with 3 mL of growth media. At 48 hours post-transfection, media from each dish is collected and assayed for activity (transient conditioned media). The cells are removed from the dish by trypsin-EDTA, diluted 1:10 and transferred to 100 mm tissue culture dishes containing 10 mL of selective media. After approximately 7 days in selective media, resistant cells grow into colonies several millimeters in diameter. The colonies are removed from the dish with filter paper (cut to approximately the same size as the colonies and soaked in trypsin/EDTA) and transferred to individual wells of a 24 well plate containing 1 mL of selective media. After the clones are grown to confluence, the conditioned media is re-assayed, and positive clones are expanded into growth media.

Expression of Multi-Functional Receptor Agonists in E. coli

E. coli strain MON105 or JM101 harboring the plasmid of interest are grown at 37° C. in M9 plus casamino acids medium with shaking in a air incubator Model G25 from New Brunswick Scientific (Edison, N.J.). Growth is monitored at OD600 until it reaches a value of 1.0 at which time Nalidixic acid (10 milligrams/mL) in 0.1 N NaOH is added to a final concentration of 50 ug/mL. The cultures are then shaken at 37° C. for three to four additional hours. A high degree of aeration is maintained throughout culture period in order to achieve maximal production of the desired gene product. The cells are examined under a light microscope for the presence of inclusion bodies (IB). One mL aliquots of the culture are removed for analysis of protein content by boiling the pelleted cells, treating them with reducing buffer and electrophoresis via SbS-PAGE (see Maniatis et al. Molecular Cloning: A Laboratory Manual, 1982). The culture is centrifuged (5000×g) to pellet the cells.

Inclusion Body Preparation, Extraction, Refolding Dialysis, DEAE Chromatography, and Characterization of the Multi-Functional Chimeric Hematopoietic Receptor Agonists which Accumulate as Inclusion Bodies in E. coli.

Isolation of Inclusion Bodies:

The cell pellet from a 330 mL E. coli culture is resuspended in 15 mL of sonication buffer (10 mM 2-amino-2-(hydroxymethyl) 1,3-propanediol hydrochloride (Tris-HCl), pH 8.0+1 mM ethylenediaminetetraacetic acid (EDTA). These resuspended cells are sonicated using the microtip probe of a Sonicator Cell Disruptor (Model W-375, Heat Systems-Ultrasonics, Inc., Farmingdale, N.Y.). Three rounds of sonication in sonication buffer followed by centrifugation are employed to disrupt the cells and wash the inclusion bodies (IB). The first round of sonication is a 3 minute burst followed by a 1 minute burst, and the final two rounds of sonication are for 1 minute each.

Extraction and Refolding of Proteins from Inclusion Body Pellets:

Following the final centrifugation step, the IB pellet is resuspended in 10 mL of 50 mM Tris-HCl, pH 9.5, 8 M urea and 5 mM dithiothreitol (DTT) and stirred at room temperature for approximately 45 minutes to allow for denaturation of the expressed protein.

The extraction solution is transferred to a beaker containing 70 mL of 5 mM Tris-HCl, pH 9.5 and 2.3 M urea and gently stirred while exposed to air at 4° C. for 18 to 48 hours to allow the proteins to refold. Refolding is monitored by analysis on a Vydac (Hesperia, Calif.) C18 reversed phase high pressure liquid chromatography (RP-HPLC) column (0.46×25 cm). A linear gradient of 40% to 65% acetonitrile, containing 0.1% trifluoroacetic acid (TFA), is employed to monitor the refold. This gradient is developed over 30 minutes at a flow rate of 1.5 mL per minute. Denatured proteins generally elute later in the gradient than the refolded proteins.

Purification:

Following the refold, contaminating E. coli proteins are removed by acid precipitation. The pH of the refold solution is titrated to between pH 5.0 and pH 5.2 using 15% (v/v) acetic acid (HOAc). This solution is stirred at 4° C. for 2 hours and then centrifuged for 20 minutes at 12,000×g to pellet any insoluble protein.

The supernatant from the acid precipitation step is dialyzed using a Spectra/Por 3 membrane with a molecular weight cut off (MWCO) of 3,500 daltons. The dialysis is against 2 changes of 4 liters (a 50-fold excess) of 10 mM Tris-HCl, pH 8.0 for a total of 18 hours. Dialysis lowers the sample conductivity and removes urea prior to DEAE chromatography. The sample is then centrifuged (20 minutes at 12,000×g) to pellet any insoluble protein following dialysis.

A Bio-Rad Bio-Scale DEAE2 column (7×52 mm) is used for ion exchange chromatography. The column is equilibrated in a buffer containing 10 mM Tris-HCl, pH 8.0, and a 0-to-500 mM sodium chloride (NaCl) gradient, in equilibration buffer, over 45 column volumes is used to elute the protein. A flow rate of 1.0 mL per minute is used throughout the run. Column fractions (2.0 mL per fraction) are collected across the gradient and analyzed by RP HPLC on a Vydac (Hesperia, Calif.) C18 column (0.46×25 cm). A linear gradient of 40% to 65% acetonitrile, containing 0.1% trifluoroacetic acid (TFA), is employed. This gradient is developed over 30 minutes at a flow rate of 1.5 mL per minute. Pooled fractions are then dialyzed against 2 changes of 4 liters (50-to-500-fold excess) of 10 mM ammonium acetate (NH4Ac), pH 4.0 for a total of 18 hours. Dialysis is performed using a Spectra/Por 3 membrane with a MWCO of 3,500 daltons. Finally, the sample is sterile filtered using a 0.22 µm syringe filter (µStar LB syringe filter, Costar, Cambridge, Mass.), and stored at 4° C.

In some cases the folded proteins can be affinity purified using affinity reagents such as mAbs or receptor subunits attached to a suitable matrix. Alternatively, (or in addition) purification can be accomplished using any of a variety of chromatographic methods such as: ion exchange, gel filtration or hydrophobic chromatography or reversed phase HPLC.

These and other protein purification methods are described in detail in Methods in Enzymology, Volume 182 'Guide to Protein Purification' edited by Murray Deutscher, Academic Press, San Diego, Calif. (1990).

Protein Characterization:

The purified protein is analyzed by RP-HPLC, electrospray mass spectrometry, and SDS-PAGE. The protein quantitation is done by amino acid composition, RP-HPLC, and Bradford protein determination. In some cases tryptic peptide mapping is performed in conjunction with electrospray mass spectrometry to confirm the identity of the protein.

AML Proliferation Assay for Bioactive Human Interleukin-3

The factor-dependent cell line AML 193 was obtained from the American Type Culture Collection (ATCC, Rockville, Md.). This cell line, established from a patient with acute myelogenous leukemia, is a growth factor dependent cell line which displayed enhanced growth in GM-CSF supplemented medium (Lange, B., et al., *Blood* 70: 192, 1987; Valtieri, M., et al., *J. Immunol.* 138:4042, 1987). The ability of AML 193 cells to proliferate in the presence of human IL-3 has also been documented. (Santoli, D., et al., *J. Immunol.* 139: 348, 1987). A cell line variant was used, AML 193 1.3, which was adapted for long term growth in IL-3 by washing out the growth factors and starving the cytokine dependent AML 193 cells for growth factors for 24 hours. The cells are then replated at $1×10^5$ cells/well in a 24 well plate in media containing 100 U/mL IL-3. It took approximately 2 months for the cells to grow rapidly in IL-3. These cells are maintained as AML 193 1.3 thereafter by supplementing tissue culture medium (see below) with human IL-3.

AML 193 1.3 cells are washed 6 times in cold Hanks balanced salt solution (HBSS, Gibco, Grand Island, N.Y.) by centrifuging cell suspensions at 250×g for 10 minutes followed by decantation of the supernatant. Pelleted cells are resuspended in HBSS and the procedure is repeated until six wash cycles are completed. Cells washed six times by this procedure are resuspended in tissue culture medium at a density ranging from $2×10^5$ to $5×10^5$ viable cells/mL. This medium is prepared by supplementing Iscove's modified Dulbecco's Medium (IMDM, Hazelton, Lenexa, Kans.) with albumin, transferrin, lipids and 2-mercaptoethanol. Bovine albumin (Boehringer-Mannheim, Indianapolis, Ind.) is added at 500 µg/mL; human transferrin (Boehringer-Mannheim, Indianapolis, Ind.) is added at 100 µg/mL; soybean lipid (Boehringer-Mannheim, Indianapolis, Ind.) is added at 50 µg/mL; and 2-mercaptoethanol (Sigma, St. Louis, Mo.) is added at $5×10^{-5}$ M.

Serial dilutions of human interleukin-3 or multi-functional chimeric hematopoietic receptor agonist proteins are made in triplicate series in tissue culture medium supplemented as stated above in 96 well Costar 3596 tissue culture plates. Each well contained 50 µl of medium containing interleukin-3 or multi-functional chimeric hematopoietic receptor agonist proteins once serial dilutions are completed. Control wells contained tissue culture medium alone (negative control). AML 193 1.3 cell suspensions prepared as above are added to each well by pipetting 50 µl ($2.5×10^4$ cells) into each well. Tissue culture plates are incubated at 37° C. with 5% $CO_2$ in humidified air for 3 days. On day 3, 0.5 µCi $^3$H-thymidine (2 Ci/mM, New England Nuclear, Boston, Mass.) is added in 50 µl of tissue culture medium. Cultures are incubated at 37° C. with 5% $CO_2$ in humidified air for 18–24 hours. Cellular DNA is harvested onto glass filter mats (Pharmacia LKB, Gaithersburg, Md.) using a TOMTEC cell harvester (TOMTEC, Orange, Conn.) which utilized a water wash cycle followed by a 70% ethanol wash cycle. Filter mats are allowed to air dry and then placed into sample bags to which scintillation fluid (Scintiverse II, Fisher Scientific, St. Louis, Mo. or BetaPlate Scintillation Fluid, Pharmacia LKB, Gaithersburg, Md.) is added. Beta emissions of samples from individual tissue culture wells are counted in a LKB BetaPlate model 1205 scintillation counter (Pharmacia LKB, Gaithersburg, Md.) and data is expressed as counts per minute of $^3$H-thymidine incorporated into cells from each tissue culture well. Activity of each human interleukin-3 preparation or multi-functional chimeric hematopoietic receptor agonist protein preparation is quantitated by measuring cell proliferation ($^3$H-thymidine incorporation) induced by graded concentrations of interleukin-3 or multi-functional chimeric hematopoietic receptor agonist. Typically, concentration ranges from 0.05 pM–$10^5$ pM are quantitated in these assays. Activity is determined by measuring the dose of interleukin-3 or multi-functional chimeric hematopoietic receptor agonist protein which provides 50% of maximal proliferation ($EC_{50}$=0.5× (maximum average counts per minute of $^3$H-thymidine incorporated per well among triplicate cultures of all concentrations of interleukin-3 tested–background proliferation measured by $^3$H-thymidine incorporation observed in triplicate cultures lacking interleukin-3). This $EC_{50}$ value is also equivalent to 1 unit of bioactivity. Every assay is performed with native interleukin-3 as a reference standard so that relative activity levels could be assigned.

Typically, the multi-functional chimeric hematopoietic receptor agonist proteins were tested in a concentration range of 2000 pM to 0.06 pM titrated in serial 2 fold dilutions.

Activity for each sample was determined by the concentration which gave 50% of the maximal response by fitting a four-parameter logistic model to the data. It was observed that the upper plateau (maximal response) for the sample and the standard with which it was compared did not differ. Therefore relative potency calculation for each sample was determined from EC50 estimations for the sample and the standard as indicated above. AML 193.1.3 cells proliferate in response to hIL-3, hGM-CSF and hG-CSF. Therefore the following additional assays were performed for some samples to demonstrate that the G-CSF receptor agonist portion of the multi-functional chimeric hematopoietic receptor agonist proteins was active. The proliferation assay was performed with the multi-functional chimeric hematopoietic receptor agonist plus and minus neutralizing monoclonal antibodies to the hIL-3 receptor agonist portion. In addition, a fusion molecule with the factor Xa cleavage site was cleaved then purified and the halves of the molecule were assayed for proliferative activity. These experiments showed that both components of the multi-functional chimeric hematopoietic receptor agonist proteins were active.

TF1 c-mpl Ligand Dependent Proliferation Assay

The c-mpl ligand proliferative activity can be assayed using a subclone of the pluripotential human cell line TF1 (Kitamura et al., J. Cell Physiol 140:323–334. [1989]). TF1 cells are maintained in h-IL3 (100 U/mL). To establish a sub-clone responsive to c-mpl ligand, cells are maintained in passage media containing 10% supernatant from BHK cells transfected with the gene expressing the 1–153 form of c-mpl ligand (pMON26448). Most of the cells die, but a subset of cells survive. After dilution cloning, a c-mpl ligand responsive clone is selected, and these cells are split into passage media to a density of $0.3 \times 10^6$ cells/mL the day prior to assay set-up. Passage media for these cells is the following: RPMI 1640 (Gibco), 10% FBS (Harlan, Lot #91206), 10% c-mpl ligand supernatant from transfected BHK cells, 1 mM sodium pyruvate (Gibco), 2 mM glutamine (Gibco), and 100 ug/mL penicillin-streptomycin (Gibco). The next day, cells are harvested and washed twice in RPMI or IMDM media with a final wash in the ATL, or assay media. ATL medium consists of the following: IMDM (Gibco), 500 ug/mL of bovine serum albumin, 100 ug/mL of human transferrin, 50 ug/mL soybean lipids, $4 \times 10^{-8}$M beta-mercaptoethanol and 2 mL of A9909 (Sigma, antibiotic solution) per 1000 mL of ATL. Cells are diluted in assay media to a final density of $0.25 \times 10^6$ cells/mL in a 96-well low evaporation plate (Costar) to a final volume of 50 ul. Transient supernatants (conditioned media) from transfected clones are added at a volume of 50 ul as duplicate samples at a final concentration of 50% and diluted three-fold to a final dilution of 1.8%. Triplicate samples of a dose curve of IL-3 variant pMON13288 starting at 1 ng/mL and diluted using three-fold dilutions to 0.0014 ng/mL is included as a positive control. Plates are incubated at 5% $CO_2$ and 37° C. At day six of culture, the plate is pulsed with 0.5 Ci of 3H/well (NEN) in a volume of 20 ul/well and allowed to incubate at 5% $CO_2$ and 37° C. for four hours. The plate is harvested and counted on a Betaplate counter.

MUTZ-2 Cell Proliferation Assay

A cell line such as MUTZ-2, which is a human myeloid leukemia cell line (German Collection of Microorganisms and Cell Cultures, DSM ACC 271), can be used to determine the cell proliferative activity of flt3 receptor agonists. MUTZ-2 cultures are maintained with recombinant native flt3 ligand (20–100 ng/mL) in the growth medium. Eighteen hours prior to assay set-up, MUTZ-2 cells are washed in IMDM medium (Gibco) three times and are resuspended in IMDM medium alone at a concentration of $0.5-0.7 \times 10E6$ cells/mL and incubated at 37° C. and 5% $CO_2$ to starve the cells of flt3 ligand. The day of the assay, standards and flt3 receptor agonists are diluted to two fold above desired final concentration in assay media in sterile tissue culture treated 96 well plates. Flt3 receptor agonists and standards are tested in triplicate. 50 $\mu$l of assay media is loaded into all wells except row A. 75 $\mu$l of the flt3 receptor agonists or standards are added to row A and 25 $\mu$l taken from that row and serial dilutions (1:3) performed on the rest of the plate (rows B through G). Row H remains as a media only control. The starved MUTZ-2 cells are washed two times in IMDM medium and resuspended in 50 $\mu$l assay media. 50 $\mu$l of cells are added to each well resulting in a final concentration of $0.25 \times 10E6$ cells/mL. Assay plates containing cells are incubated at 37° C. and 5% $CO_2$ for 44 hrs. Each well is then pulsed with 1 $\mu$Ci/well of tritiated thymidine in a volume of 20 $\mu$l for four hours. Plates are then harvested and counted.

Other In Vitro Cell Based Proliferation Assays

Other in vitro cell based assays, known to those skilled in the art, may also be useful to determine the activity of the multi-functional chimeric hematopoietic receptor agonists depending on the factors that comprise the molecule in a similar manner as described in the AML 193.1.3 cell proliferation assay. The following are examples of other useful assays.

TF1 proliferation assay: TF1 is a pluripotential human cell line (Kitamura et al., J. Cell Physiol 140:323–334. [1989]) that responds to hIL-3.

32D proliferation assay: 32D is a murine IL-3 dependent cell line which does not respond to human IL-3 but does respond to human G-CSF which is not species restricted.

Baf/3 proliferation assay: Baf/3 is a murine IL-3 dependent cell line which does not respond to human IL-3 or human c-mpl ligand but does respond to human G-CSF which is not species restricted.

T1165 proliferation assay: T1165 cells are a IL-6 dependent murine cell line (Nordan et al., 1986) which respond to IL-6 and IL-11.

Human Plasma Clot meg-CSF Assay: Used to assay megakaryocyte colony formation activity (Mazur et al., 1981).

Transfected Cell Lines:

Cell lines such as the murine Baf/3 cell line can be transfected with a colony stimulating factor receptor, such as the human G-CSF receptor or human c-mpl receptor, which the cell line does not have. These transfected cell lines can be used to determine the activity of the ligand for which the receptor has been transfected into the cell line.

One such transfected Baf/3 cell line was made by cloning the cDNA encoding c-mpl from a library made from a c-mpl responsive cell line and cloned into the multiple cloning site of the plasmid pcDNA3 (Invitrogen, San Diego Calif.). Baf/3 cells were transfected with the plasmid via electroporation. The cells were grown under G418 selection in the presence of mouse IL-3 in Wehi conditioned media. Clones were established through limited dilution.

In a similar manner the human G-CSF receptor can be transfected into the Baf/3 cell line and used to determine the bioactivity of the multi-functional chimeric hematopoietic receptor agonists.

Analysis of c-mpl Ligand Proliferative Activity

Methods

1. Bone Marrow Proliferation Assay a. CD34+ Cell Purification:

Bone marrow aspirates (15–20 mL) were obtained from normal allogeneic marrow donors after informed consent. Cells were diluted 1:3 in phosphate buffered saline (PBS, Gibco-BRL), 30 mL were layered over 15 mL Histopaque-1077 (Sigma) and centrifuged for 30 minutes at 300 RCF. The mononuclear interface layer was collected and washed in PBS. CD34+ cells were enriched from the mononuclear cell preparation using an affinity column per manufacturers instructions (CeliPro, Inc., Bothell Wash.). After enrichment, the purity of CD34+ cells was 70% on average as determined by using flow cytometric analysis using anti-CD34 monoclonal antibody conjugated to fluorescein and anti-CD38 conjugated to phycoerythrin (Becton Dickinson, San Jose Calif.).

Cells were resuspended at 40,000 cells/mL in X-Vivo 10 media (Bio-Whittaker, Walkersville, Md.) and 1 mL was plated in 12-well tissue culture plates (Costar). The growth factor rhIL-3 was added at 100 ng/mL (pMON5873) was added to some wells. hIL3 variants were used at 10 ng/mL to 100 ng/mL. Conditioned media from BHK cells transfected with plasmid encoding c-mpl ligand or multi-functional chimeric hematopoietic receptor agonists were tested by addition of 100 µl of supernatant added to 1 mL cultures (approximately a 10% dilution). Cells were incubated at 37° C. for 8–14 days at 5% $CO_2$ in a 37° C. humidified incubator.

b. Cell Harvest and Analysis:

At the end of the culture period a total cell count was obtained for each condition. For fluorescence analysis and ploidy determination cells were washed in megakaryocyte buffer (MK buffer, 13.6 mM sodium citrate, 1 mM theophylline, 2.2 µm PGE1, 11 mM glucose, 3% w/v BSA, in PBS, pH 7.4) (Tomer et al., *Blood* 70: 1735–1742, 1987) resuspended in 500 µl of MK buffer containing anti-CD41a FITC antibody (1:200, AMAC, Westbrook, Me.) and washed in MK buffer. For DNA analysis cells were permeablized in MK buffer containing 0.5% Tween 20 (Fisher, Fair Lawn N.J.) for 20 min. on ice followed by fixation in 0.5% Tween-20 and 1% paraformaldehyde (Fisher Chemical) for 30 minutes followed by incubation in propidium iodide (Calbiochem La Jolla Calif.) (50 µg/mL) with RNA-ase (400 U/mL) in 55% v/v MK buffer (200 mOsm) for 1–2 hours on ice. Cells were analyzed on a FACScan or Vantage flow cytometer (Becton Dickinson, San Jose, Calif.). Green fluorescence (CD41a-FITC) was collected along with linear and log signals for red fluorescence (PI) to determine DNA ploidy. All cells were collected to determine the percent of cells that were CD41+. Data analysis was performed using software by LYSIS (Becton Dickinson, San Jose, Calif.). Percent of cells expressing the CD41 antigen was obtained from flow cytometry analysis(Percent). Absolute (Abs) number of CD41+ cells/mL was calculated by: (Abs)=(Cell Count)*(Percent)/100.

2. Megakaryocyte Fibrin Clot Assay.

CD34+ enriched population were isolated as described above. Cells were suspended at 25,000 cells/mL with or without cytokine(s) in a media consisting of a base Iscoves IMDM media supplemented with 0.3% BSA, 0.4 mg/mL apo-transferrin, 6.67 µM $FeCl_2$, 25 µg/mL $CaCl_2$, 25 µg/mL L-asparagine, 500 µg/mL e-amino-n-caproic acid and penicillin/streptomycin. Prior to plating into 35 mm plates, thrombin was added (0.25 Units/mL) to initiate clot formation. Cells were incubated at 37° C. for 13 days at 5% $CO_2$ in a 37° C. humidified incubator.

At the end of the culture period plates were fixed with methanol:acetone (1:3), air dried and stored at −200C until staining. A peroxidase immunocytochemistry staining procedure was used (Zymed, Histostain-SP. San Francisco, Calif.) using a cocktail of primary monoclonal antibodies consisting of anti-CD41a, CD42 and CD61. Colonies were counted after staining and classified as negative, CFU-MK (small colonies, 1–2 foci and less that approx. 25 cells), BFU-MK (large, multi-foci colonies with >25 cells) or mixed colonies (mixture of both positive and negative cells.

Methylcellulose Assay

This assay reflects the ability of colony stimulating factors to stimulate normal bone marrow cells to produce different types of hematopoietic colonies in vitro (Bradley et al., *Aust. Exp Biol. Sci.* 44:287–300, 1966), Pluznik et al., *J. Cell Comp. Physio* 66:319–324, 1965).

Methods

Approximately 30 mL of fresh, normal, healthy bone marrow aspirate are obtained from individuals following informed consent. Under sterile conditions samples are diluted 1:5 with a 1×PBS (#14040.059 Life Technologies, Gaithersburg, Md.) solution in a 50 mL conical tube (#25339–50 Corning, Corning Md). Ficoll (Histopaque 1077 Sigma H-8889) is layered under the diluted sample and centrifuged, 300×g for 30 min. The mononuclear cell band is removed and washed two times in 1×PBS and once with 1% BSA PBS (CellPro Co., Bothel, Wash.). Mononuclear cells are counted and CD34+ cells are selected using the Ceprate LC (CD34) Kit (CellPro Co., Bothel, Wash.) column. This fractionation is performed since all stem and progenitor cells within the bone marrow display CD34 surface antigen.

Cultures are set up in triplicate with a final volume of 1.0 mL in a 35×10 mm petri dish (Nunc#174926). Culture medium is purchased from Terry Fox Labs. (HCC-4230 medium (Terry Fox Labs, Vancouver, B. C., Canada) and erythropoietin (Amgen, Thousand Oaks, Calif.) is added to the culture media. 3,000–10,000 CD34+ cells are added per dish. Recombinant IL-3, purified from mammalian cells or *E. coli*, and multi-functional chimeric hematopoietic receptor agonist proteins, in conditioned media from transfected mammalian cells or purified from conditioned media from transfected mammalian cells or *E. coli*, are added to give final concentrations ranging from 0.001 nM to 10 nM. Recombinant hIL-3, GM-CSF, c-mpl ligand and multi-functional chimeric hematopoietic receptor agonist are supplied in house. G-CSF (Neupogen) is from Amgen (Thousand Oaks Calif.). Cultures are resuspended using a 3 cc syringe and 1.0 mL is dispensed per dish. Control (baseline response) cultures received no colony stimulating factors. Positive control cultures received conditioned media (PHA stimulated human cells: Terry Fox Lab. H2400). Cultures are incubated at 37° C., 5% $CO_2$ in humidified air.

Hematopoietic colonies which are defined as greater than 50 cells are counted on the day of peak response (days 10–11) using a Nikon inverted phase microscope with a 40× objective combination. Groups of cells containing fewer than 50 cells are referred to as clusters. Alternatively colonies can be identified by spreading the colonies on a slide and stained or they can be picked, resuspended and spun onto cytospin slides for staining.

Human Cord Blood Hemopoietic Growth Factor Assays

Bone marrow cells are traditionally used for in vitro assays of hematopoietic colony stimulating factor (CSF) activity. However, human bone marrow is not always available, and there is considerable variability between donors. Umbilical cord blood is comparable to bone marrow as a source of hematopoietic stem cells and progenitors (Broxmeyer et al., *PNAS USA* 89:4109–113, 1992; Mayani et al., *Blood* 81:3252–3258, 1993). In contrast to bone marrow, cord blood is more readily available on a regular basis. There is also a potential to reduce assay variability by pooling cells obtained fresh from several donors, or to create a bank of cryopreserved cells for this purpose. By modifying the culture conditions, and/or analyzing for lineage specific markers, it is be possible to assay specifically for granulocyte/macrophage colonies (CFU-GM), for megakaryocyte CSF activity, or for high proliferative potential colony forming cell (HPP-CFC) activity.

Methods

Mononuclear cells (MNC) are isolated from cord blood within 24 hr. of collection, using a standard density gradient (1.077 g/mL Histopaque). Cord blood MNC have been further enriched for stem cells and progenitors by several procedures, including immunomagnetic selection for CD14−, CD34+ cells; panning for SBA−, CD34+ fraction using coated flasks from Applied Immune Science (Santa Clara, Calif.); and CD34+ selection using a CellPro (Bothell, Wash.) avidin column. Either freshly isolated or cryopreserved CD34+ cell enriched fractions are used for the assay. Duplicate cultures for each serial dilution of sample (concentration range from 1 pM to 1204 pM) are prepared with $1 \times 10^4$ cells in 1 ml of 0.9% methylcellulose containing medium without additional growth factors (Methocult H4230 from Stem Cell Technologies, Vancouver, BC.). In some experiments, Methocult H4330 containing erythropoietin (EPO) was used instead of Methocult H4230, or Stem Cell Factor (SCF), 50 ng/mL (Biosource International, Camarillo, Calif.) was added. After culturing for 7–9 days, colonies containing >30 cells are counted. In order to rule out subjective bias in scoring, assays are scored blind.

Additional details about recombinant DNA methods which may be used to create the variants, express them in bacteria, mammalian cells or insect cells, purification and refold of the desired proteins and assays for determining the bioactvity of the proteins may be found in co-filed Applications WO 95/00646, WO 94/12639, WO 94/12638, WO 95/20976, WO 95/21197, WO 95/20977, WO 95/21254 and U.S. Ser. No. 08/383,035 which are hereby incorporated by reference in their entirety.

Further details known to those skilled in the art may be found in T. Maniatis, et al., *Molecular Cloning, A Laboratory Manual*, Cold Spring Harbor Laboratory, 1982) and references cited therein, incorporated herein by reference; and in J. Sambrook, et al., *Molecular Cloning, A Laboratory Manual*, 2nd edition, Cold Spring Harbor Laboratory, 1989) and references cited therein, incorporated herein by reference.

TABLE 1

| OLIGONUCLEOTIDES | |
|---|---|
| c-mplNcoI<br>N = A, C, G or T | ACGTCCATGGCNTCNCCNGCNCCNCCTGCTTGTGCACTCCGAGTC SEQ ID NO:317 |
| Ecompl | ATGCACGAATTCCCTGACGCAGAGGGTGGA SEQ ID NO:318 |
| c-mplHindIII | TGACAAGCTTACCTGACGCAGAGGGTGGACCCT SEQ ID NO:319 |
| 4L-5' | AATTCGGCAA SEQ ID NO:320 |
| 4L-3' | CATGTTGCCG SEQ ID NO:321 |
| 5L-5' | AATTCGGCGGCAA SEQ ID NO:322 |
| 5L-3' | CATGTTGCCGCCG SEQ ID NO:323 |
| 8L-5' | AATTCGGCGGCAACGGCGGCAA SEQ ID NO:324 |
| 8L-3' | CATGTTGCCGCCGTTGCCGCCG SEQ ID NO:325 |
| 31-5' | CGATCCATGGAGGTTCACCCTTTGCCT SEQ ID NO:326 |
| 31-3' | GATCAAGCTTATGGGCACTGGCTCAGTCT SEQ ID NO:327 |
| 35-5' | CGATACATGTTGCCTACACCTGTCCTG SEQ ID NO:328 |
| 35-3' | GATCAAGCTTAAGGGTGAACCTCTGGGCA SEQ ID NO:329 |
| 39-5' | CGATCCATGGTCCTGCTGCCTGCTGTG SEQ ID NO:330 |
| 39-3' | GATCAAGCTTAAGGTGTAGGCAAAGGGTG SEQ ID NO:331 |
| 43-5' | CGATCCATGGCTGTGGACTTTAGCTTGGGA SEQ ID NO:332 |
| 43-3' | GATCAAGCTTAAGGCAGCAGGACAGGTGT SEQ ID NO:333 |
| 45-5' | CGATCCATGGACTTTAGCTTGGGAGAA SEQ ID NO:334 |
| 45-3' | GATCAAGCTTACACAGCAGGCAGCAGGAC SEQ ID NO:335 |
| 49-5' | CGATCCATGGGAGAATGGAAAACCCAG SEQ ID NO:336 |
| 49-3' | GATCAAGCTTACAAGCTAAAGTCCACAGC SEQ ID NO:337 |
| 82-5' | CGATCCATGGGACCCACTTGCCTCTCA SEQ ID NO:338 |
| 82-3' | GATCAAGCTTACAGTTGTCCCCGTGCTGC SEQ ID NO:339 |
| 109-5' | CAGTCCATGGGAACCCAGCTTCCTCCA SEQ ID NO:340 |
| 109-3' | GATCAAGCTTAAAGGAGGCTCTGCAGGGC SEQ ID NO:341 |
| 116-5' | CGATCCATGGGCAGGACCACAGCTCAC SEQ ID NO:342 |
| 116-3' | GATCAAGCTTACTGTGGAGGAAGCTGGGTT SEQ ID NO:343 |
| 120-5' | CGATCCATGGCTCACAAGGATCCCAATGCC SEQ ID NO:344 |
| 120-3' | GATCAAGCTTATGTGGTCCTGCCCTGTGG SEQ ID NO:345 |
| 123-5' | CGATCCATGGATCCCAATGCCATCTTCCTG SEQ ID NO:346 |
| 123-3' | GATCAAGCTTACTTGTGAGCTGTGGTCCT SEQ ID NO:347 |
| 126-5' | CGATCCATGGCCATCTTCCTGAGCTTCCAA SEQ ID NO:348 |
| 126-3' | GATCAAGCTTAATTGGGATCCTTGTGAGCTGT SEQ ID NO:349 |
| SYNNOXA1.REQ | AATTCCGTCG TAAACTGACC TTCTATCTGA AAACCTTGGA GAACGCGCAG GCTCAACAGT ACGTAGAGGG CGGTGGAGGC TCC SEQ ID NO:350 |
| SYNNOXA2.REQ | CCGGGGAGCC TCCACCGCCC TCTACGTACT GTTGAGCCTG CGCGTTCTCC AAGGTTTTCA GATAGAAGGT CAGTTTACGA CGG SEQ ID NO:351 |
| L1syn.for | GTTACCCTTG AGCAAGCGCA GGAACAACAG GGTGGTGGCT CTAACTGCTC TATAATGAT SEQ ID NO:352 |
| L1syn.rev | CGATCATTAT AGAGCAGTTA GAGCCACCAC CCTGTTGTTC CTGCGCTTGC TCAAGG SEQ ID NO:353 |
| L3syn.for | GTTACCCTTG AGCAAGCGCA GGAACAACAG GGTGGTGGCT CTGGCGGTGG CAGCGGCGGC GGTTCTAACT GCTCTATAAT GAT SEQ ID NO:354 |

TABLE 1-continued

OLIGONUCLEOTIDES

| | |
|---|---|
| L3syn.rev | CGATCATTAT AGAGCAGTTA GAACCGCCGC CGCTGCCACC GCCAGAGCCA CCACCCTGTT GTTCCTGCGC TTGCTCAAGG SEQ ID NO:355 |
| 35start.seq | GATCGACCAT GGCTCTGGAC CCGAACAACC TC SEQ ID NO:356 |
| 34rev.seq | CTCGATTACG TACAAAGGTG CAGGTGGT SEQ ID NO:357 |
| 70start.seq | GATCGACCAT GGCTAATGCA TCAGGTATTG AG SEQ ID NO:358 |
| 69rev.seq | CTCGATTACG TATTCTAAGT TCTTGACA SEQ ID NO:359 |
| 91start.seq | GATCGACCAT GGCTGCACCC TCTCGACATC CA SEQ ID NO:360 |
| 90rev.seq | CTCGATTACG TAGGCCGTGG CAGAGGGC SEQ ID NO:361 |
| 101start.seq | GATCGACCAT GGCTGCAGGT GACTGGCAAG AA SEQ ID NO:362 |
| 100rev.seq | CTCGATTACG TACTTGATGA TGATTGGA SEQ ID NO:363 |
| L-11start.seq | GCTCTGAGAG CCGCCAGAGC CGCCAGAGGG CTGCGCAAGG TGGCGTAGAA CGCG SEQ ID NO:364 |
| L-11stop.seq | CAGCCCTCTG GCGGCTCTGG CGGCTCTCAG AGCTTCCTGC TCAAGTCTTT AGAG SEQ ID NO:365 |
| P-blstart.seq | GGGCTGCGCA AGGTGGCG SEQ ID NO:366 |
| P-blstop.seq | ACACCATTGG GCCCTGCCAG C SEQ ID NO:367 |
| 39start.seq | GATCGACCAT GGCTTACAAG CTGTGCCACC CC SEQ ID NO:368 |
| 38stop.Seq | CGATCGAAGC TTATTAGGTG GCACACAGCT TCTCCT SEQ ID NO:369 |
| 97start.seq | GATCGACCAT GGCTCCCGAG TTGGGTCCCA CC SEQ ID NO:370 |
| 96stop.Seq | CGATCGAAGC TTATTAGGAT ATCCCTTCCA GGGCCT SEQ ID NO:371 |
| 126start.seq | GATCGACCAT GGCTATGGCC CCTGCCCTGC AG SEQ ID NO:372 |
| 125stop.Seq | CGATCGAAGC TTATTATCCC AGTTCTTCCA TCTGCT SEQ ID NO:373 |
| 133start.seq | GATCGACCAT GGCTACCCAG GGTGCCATGC CG SEQ ID NO:374 |
| 132stop.seq | CGATCGAAGC TTATTAGGGC TGCAGGGCAG GGGCCA SEQ ID NO:375 |
| 142start.seq | GATCGACCAT GGCTTCTGCT TTCCAGCGCC GG SEQ ID NO:376 |
| 141stop.Seq | CGATCGAAGC TTATTAGGCG AAGGCCGGCA TGGCAC SEQ ID NO:377 |
| GLYXA1 | GTAGAGGGCG GTGGAGGCTC C SEQ ID NO:378 |
| GLYXA2 | CCGGGGAGCC TCCACCGCCC TCTAC SEQ ID NO:379 |
| 1GGGSfor | TTCTACGCCA CCTTGCGCAG CCCGGCGGCG GCTCTGACAT GTCTACACCA TTG SEQ ID NO:380 |
| 1GGGSrev | CAATGGTGTA GACATGTCAG AGCCGCCGCC GGGCTGCGCA AGGTGGCGTA GAA SEQ ID NO:381 |
| NCOFLT | CTGACCATGGCNACCCAGGACTGCTCCTTCCAA SEQ ID NO:807 |
| HIND160 | ACTGAAGCTTAGGGCTGACACTGCAGCTCCAG SEQ ID NO:808 |
| HIND165 | ACTGAAGCTTACAGGGTTGAGGAGTCGGGCTG SEQ ID NO:809 |
| FL23For | GACTGCCATGGCNACYCAGGAYTGYTCYTTYCAACACAGCCCCATC SEQ ID NO:810 |
| FH3AFor | GACTGCCATGGCNACYCAGGAYTGYTCYTTYCAACACAGCCCCATC SEQ ID NO:811 |
| SCF.REV | TGTCCAAACTCATCAATGTATC SEQ ID NO:812 |
| 39FOR | CATGGCCATGGCCGACGAGGAGCTCTGCGGGGGCCTCT SEQ ID NO:813 |
| 39REV | GCTAGAAGCTTACTGCAGGTTGGAGGCCACGGTGAC SEQ ID NO:814 |
| 65FOR | CATGGCCATGGCCTCCAAGATGCAAGGCTTGCTGGAGC SEQ ID NO:815 |
| 65REV | GCTAGAAGCTTACCCAGCGACAGTCTTGAGCCGCTC SEQ ID NO:816 |
| 89FOR | CATGGCCATGGCCCCCCCCAGCTGTCTTCGCTTCGT SEQ ID NO:817 |
| 89REV | GCTAGAAGCTTAGGGCTGAAAGGCACATTTGGTGACA SEQ ID NO:818 |
| L5A | CCCTGTCTGGCGGCAACGGCACCCAGGACTGCTCCTTCCAAC SEQ ID NO:819 |
| L10A | GCGGTAACGGCAGTGGAGGTAATGGCACCCAGGACTGCTCCTTCCAAC SEQ ID NO:820 |
| L15A | ACGGCAGTGGTGGCAATGGGAGCGGCGGAAATGGAACCCAGGACT GCTCCTTCCAAC SEQ ID NO:821 |
| L5B | GTGCCGTTGCCGCCAGACAGGGTTGAGGAGTCGGGCTG SEQ ID NO:822 |
| L10B | ATTACCTCCACTGCCGTTACCGCCTGACAGGGTTGAGGAGTCGGG CTG SEQ ID NO:823 |
| L15B | GCTCCCATTGCCACCACTGCCGTTACCTCCAGACAGGGTTGAGGA GTCGGGCTG SEQ ID NO:824 |
| L15C | GATGAGGATCCGGTGGCAATGGGAGCGGCGGAAATGGAACCCAGG ACTGCTCCTTCCACC SEQ ID NO:825 |
| L15D | GATGACGGATCCGTTACCTCCAGACAGGGTTGAGGAGTCGGGCTG SEQ ID NO:826 |
| L15E | GATGACGGATCCGGAGGTAATGGCACCCAGGACTGCTCCTTCCAAC SEQ ID NO:827 |
| 339FOR2 | GACTGCCATGGCCGACGAGGAGCTCTGCG SEQ ID NO:828 |
| 339REV2 | GACTCAAGCTTACTGCAGGTTGGAGGCC SEQ ID NO:829 |
| 339-10FOR3 | GACTCGGGATCCGGAGGTTCTGGCACCCAGGACTGCTCC SEQ ID NO:830 |
| 339-15FOR2 | GACTGGGATCCGGTGGCAGTGGGAGCGGCGGATCTGGAACC SEQ ID NO:831 |
| 339REV3 | GACTTGGGATCCACTACCTCCAGACAGGGTTGAGGA GTC SEQ ID NO:832 |
| FLN3 | ACTGACGGATCCACCGCCCAGGGTTGAGGAGTCGGGCTG SEQ ID NO:833 |
| FLN7 | ACTGACGGATCCACCTCCTGACCCACCGCCCAGGGTTGAGGAGTCGGGCTG SEQ ID NO:834 |
| FLN11 | ACTGACGGATCCACCTCCTGACCCACCTCCTGACCCACCGCCCAG GGTTGAGGAGTCGGGCTG SEQ ID NO:835 |
| C-term | ACGTAAAGCTTACAGGGTTGAGGAGTCG SEQ ID NO:836 |
| FLC3 | GTCAGTGGATCCGGAGGTACCCAGGACTGCTCCTTCCAA C SEQ ID NO:837 |
| FLC4 | GTCAGTGGATCCGGAGGTGGCACCCAGGACTGCTCCTTCCAAC SEQ ID NO:838 |
| FLC10 | TCAGTGGATCCGGAGGTGGCTCAGGGGGAGGTAGTGGTACCCAG GACTGCTCCTTCCAAC SEQ ID NO:839 |
| N-term | TAGTCCATGGCCACCCAGGACTGCTCC SEQ ID NO:840 |
| 134.rev | GCATTACGTAGGGCTGACACTGCAGCTCCAG SEQ ID NO:841 |
| 139.rev | GCATTACGTACAGGGTTGAGGAGTCGGGCTG SEQ ID NO:842 |
| Fl29for | GTCAGACCATGGCCGATTACCCAGTCACCGTGGCCTC SEQ ID NO:843; |
| FL29rev | TCTGACAAGCTTATTGAAGCAGGTAGTCAGACAGCTCAC SEQ ID NO:844; |
| FL35for | GTCAGCCCATGGCCGCCTCCAACCTGCAGGACGAGGA SEQ ID NO:845; |
| FL35rev | TCTGACAAGCTTACACGGTGACTGGGTAACTTGAAGC SEQ ID NO:846; |

TABLE 1-continued

OLIGONUCLEOTIDES

| | |
|---|---|
| FL63for | GTCAGACCATGGCCGTCGCTGGGTCCAAGATGCAAGGC SEQ ID NO:847; |
| FL63rev | TCTGACAAGCTTAAGTCTTGAGCCGCTCCATCCAGCG SEQ ID NO:848; |
| FL95for | GTCAGACCATGGCCCGCTTCGTCCAGACCAACATCTCC SEQ ID NO:849; |
| FL95rev | TCTGACAAGCTTAAAGACAGCTGGGGGGGGGCTGAA SEQ ID NO:850; |
| FL99for | GTCAGACCATGGCCACCAACATCTCCCGCCTCCTGCAG SEQ ID NO:851; |
| FL99rev | CTCGACAAGCTTACTGGACGAAGCGAAGACAGCTGGG SEQ ID NO:852; |
| FLTAFLS1 | GATCACATGTCTACAAATCAAGATCTGCCTGTG SEQ ID NO:853 |
| FLTR1N | GATCGAATTCGTTGTCTTGGATGAAAGGGA SEQ ID NO:854 |
| HGCFOR | ACTTGAATTCATCATCCTGGGCCTGTTCGGGC SEQ ID NO:855 |
| HGCREV | ACTCAAGCTTAGAAGCTCCCCAGCGCCTCC SEQ ID NO:856 |
| FL29FOR | GTCAGACCATGGCCGATTACCCAGTCACCGTGGCCTC SEQ ID NO:382 |
| FL35FOR | GTCAGCCCATGGCCGCCTCCAACCTGCAGGACGAGGA SEQ ID NO:383 |
| FL63FOR | GTCAGACCATGGCCGTCGCTGGGTCCAAGATGCAAGGC SEQ ID NO:384 |
| FL95FOR | GTCAGACCATGGCCCGCTTCGTCCAGACCAACATCTCC SEQ ID NO:385 |
| FL99FOR | GTCAGACCATGGCCACCAACATCTCCCGCCTCCTGCAG SEQ ID NO:386 |
| FL29REV | TCTGACAAGCTTATTGAAGCAGGTAGTCAGACAGCTCAC SEQ ID NO:387 |
| FL35REV | TCTGACAAGCTTACACGGTGACTGGGTAATCTTGAAGC SEQ ID NO:388 |
| FL63REV | TCTGACAAGCTTAAGTCTTGAGCCGCTCCATCCAGCG SEQ ID NO:389 |
| 89 REVSTOP | GTCAAGAAGCTTACGGCTGAAAGGCACATTTG SEQ ID NO:390 |
| FL95REV | TCTGACAAGCTTAAAGACAGCTGGGGGGGGGCTGAA SEQ ID NO:391 |
| FL99REV | CTCGACAAGCTTACTGGACGAAGCGAAGACAGCTGGG SEQ ID NO:392 |
| Flt36 | GTTGCCATGGCNTCNAAYCTGCARGAYGARGARCTGT GCGGGGGCCTCTGGCGGCTG SEQ ID NO:393 |
| Flt37 | GTTGCCATGGCNAAYCTGCARGAYGARGARCTGTGYG GGGGCCTCTGGCGGCTGGTC SEQ ID NO:394 |
| Flt38 | GTTGCCATGGCNCTGCARGAYGARGARCTGTGYGGYG GCCTCTGGCGGCTGGTCCTG SEQ ID NO:395 |
| Flt39 | GTTGCCATGGCNCARGAYGARGARCTGTGYGGYGGYC TCTGGCGGCTGGTCCTGGCA SEQ ID NO:396 |
| Flt40 | GTTGCCATGGCNGAYGARGARCTGTGYGGYGGYCTCT GGCGGCTGGTCCTGGCACAG SEQ ID NO:397 |
| Flt41 | GTTGCCATGGCNGARGARCTGTGYGGYGGYCTCTGGC GGCTGGTCCTGGCACAGCGC SEQ ID NO:398 |
| Flt42 | GTTGCCATGGCNGARCTGTGYGGYGGYCTGTGGCGYC TGGTCCTGGCACAGCGCTGG SEQ ID NO:399 |
| Flt43 | GTTGCCATGGCNCTGTGYGGYGGYCTGTGGCGYCTGG TCCTGGCACAGCGCTGGATG SEQ ID NO:400 |
| 40 COLI | GTTGCCATGGCWGATGAAGAACTGTGTGGNGGNCTGTGGCGG SEQ ID NO:401 |
| 36REV | TATGCAAGCTTAGGCCACGGTGACTGGGTA SEQ ID NO:402 |
| 37REV | TATGCAAGCTTAGGAGGCCACGGTGACTGG SEQ ID NO:403 |
| 38REV | TATGCAAGCTTAGTTGGAGGCCACGGTGAC SEQ ID NO:404 |
| 39REV | TATGCAAGCTTACAGGTTGGAGGCCACGGT SEQ ID NO:405 |
| 41REV | TATGCAAGCTTAGTCCAGGTTGGAGGCCAC SEQ ID NO:406 |
| 42REV | TATGCAAGCTTACTCGTCCAGGTTGGAGGC SEQ ID NO:407 |
| 43REV | TATGCAAGCTTACTCCTCGTCCAGGTTGGA SEQ ID NO:408 |
| 39N TERM-2 | GACTAGCCATGGCNGAYGARGARCTGTGYGGTGGCCTCTGGCGG SEQ ID NO:409 |
| SNA B1CTERM | GACTAGTACGTACTGCAGGTTGGAGGCCACGG SEQ ID NO:410 |
| 29SMB1 | GCAGGTTACGTATTGAAGCAGGTAGTCAGACAGCTC SEQ ID NO:411 |
| 34SNAB1 | GCAGGTTACGTACACGGTGACTGGGTAATCTTGAAG SEQ ID NO:412 |
| 63SNAB1 | GCAGGTTACGTAAGTCTTGAGCCGCTCCATCCAGC SEQ ID NO:413 |
| 66SNAB1 | GCAGGTTACGTAGCCAGCGACAGTCTTGAGCCGCTC SEQ ID NO:414 |
| 89N-TERMCSLI | GTCAAGCCATGGCNCCRCCRAGCTGTCTRCGCT TCGTTCAGACCAACTC SEQ ID NO:415 |
| 89SNAB1 | GCAGGTTACGTACGGCTGAAAGGCACATTTGGTGACAA SEQ ID NO:416 |
| 945 SMB1 | GCAGGTTACGTAAAGACAGCTGGGGGGGGG SEQ ID NO:417 |
| 98SUAB1 | GCAGGTTACGTACTGGACGAAGCGAAGACAGCTG SEQ ID NO:418 |
| BAM FOR 1 | TCAGTTGGATCCGGCGGCGGAAGCGGAGGTGGCTCTGGGGAGGTA SEQ ID NO:426 |
| BAM REV 1 | TCAGTTGGATCCTCCGCCAGAACCACCGCCTGACCCACCTCCTGACCC SEQ ID NO:427 |
| NAVREV L | GTCTGAGGCGCCACCGCACCGACCGCTGGACAACCGCCTCTGACCC AGGACTGCTCCTTC SEQ ID NO:428 |
| NAVREV S | GTCTGAGGCGCCACCGCACCGACCACCCAGGACTGCTCCTTCCAAC SEQ ID NO:429 |
| NAVFOR | GTCTGAGGCGCCGAGTGGACGCGGGCTCCACGGTGGCGGCAGGGT TGAGGAGTCGGGCTG SEQ ID NO:430 |
| XBAFOR1 | GCTACGTCTAGATCTCCTGACCTCGACCCAGGACTGCTCCTTCCAAC SEQ ID NO:447 |
| XBAREV1 | GCTAGTTCTAGACCATCCTGGCTGACACGGTGAAACACCGTCTCTACG GGCTGACACTGCAGCTCCAG SEQ ID NO:448 |
| LNK1FOR | GTCAGTACTAGTATGGGTGTCCGGGCTCTTCGGCTCCTGCAGG TTGGAGGCCACGG SEQ ID NO:449 |
| LNK1REV | GTCAGTACTAGTCCGCCATCTCCGACACCATTAGGCCCTGCCAGC SEQ ID NO:450 |
| LNK2FOR | GTCAGTTCCGGAGATTTCGGTTCTGCAGAGGGCTGCGCAAGG TGGCGTA SEQ ID NO:451 |

TABLE 1-continued

OLIGONUCLEOTIDES

| | |
|---|---|
| LNK2REV | GTCAGTTCCGGATACTCATACCAGCCCGCCATCCCCGGGTTCTA ATCTGCAAGATGAAGAGCTG SEQ ID NO:452 |
| LNK7FOR | GTCAGTACTAGTATGGGTGTCCGGGCTCTTCGGAAAGGCACATTT GGTGACAAAGTGTATC SEQ ID NO:453 |
| LNK7REV | GTCAGTACTAGTCCGCCATCTCCGGGTACACCATTAGGCCCTG CCAGC SEQ ID NO:454 |
| LNK8REV | GTCAGTTCCGGATACTCATACCAGCCCGCCATCCCCGGGTAAGGCC TTTCAGCCCCCCCCCAG SEQ ID NO:455 |
| C1FOR | GTCAGACCATGGCCACTCAGGACTCCTCTTTTC SEQ ID NO:456 |
| C3FOR | CACTTTGTCACCAAATCTGCCTTTCAG SEQ ID NO:457 |
| C3REV | CTGAAAGGCAGATTTGGTGACAAAGTG SEQ ID NO:458 |
| C5FOR | GCCCCCCCCCAGCTCTCTTCG SEQ ID NO:459 |
| C5REV | CGAAGAGAGCTGGGGGGGGGC SEQ ID NO:460 |
| C6REV | GTCAGTTACGTACAGGGTTGAAGGAGTCGGGCTGAGACTGC SEQ ID NO:461 |
| GPFOR1 | GTCAGTCCATGGCTACTCAAGGTGCTATGC SEQ ID NO:462 |
| GPREV2 | GTAGCATACGTAGGGCTGCAGGGCAGGGCC SEQ ID NO:463 |

TABLE 2

GENE SEQUENCES pMON30304

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCGGGTGAACCGTCT
GGTCCAATCTCTACTATCAACCCGTCTCCTCCGTCTAAAGAATCTCATAAATCTCCAAACATGT SEQ ID
NO:1 pMON26458

TCCCCAGCTCCACCTGCTTGTGACCTCCGAGTCCTCAGTAAACTGCTTCGTGACTCCCATGTCCTTCACAGCAGA
CTGAGCCAGTGCCCAGAGGTTCACCCTTTGCCTACACCTGTCCTGCTGCCTGCTGTGGACTTTAGCTTGGGAGAA
TGGAAAACCCAGATGGAGGAGACCAAGGCACAGGACATTCTGGGAGCAGTGACCCTTCTGCTGGAGGGAGTGATG
GCAGCACGGGGACAACTGGGACCCACTTGCCTCTCATCCCTCCTGGGGCAGCTTTCTGGACAGGTCCGTCTCCTC
CTTGGGGCCCTGCAGAGCCTCCTTGGAACCCAGCTTCCTCCACAGGGCAGGACCACAGCTCACAAGGATCCCAAT
GCCATCTTCCTGAGCTTCCAACACCTGCTCCGAGGAAAGGTGCGTTTCCTGATGCTTGTAGGAGGGTCCACCCTC
TGCGTCAGGGAATTC SEQ ID NO:2 pMON28548

TCCCCAGCTCCACCTGCTTGTGACCTCCGAGTCCTCAGTAAACTGCTTCGTGACTCCCATGTCCTTCACAGCAGA
CTGAGCCAGTGCCCAGAGGTTCACCCTTTGCCTACACCTGTCCTGCTGCCTGCTGTGGACTTTAGCTTGGGAGAA
TGGAAAACCCAGATGGAGGAGACCAAGGCACAGGACATTCTGGGAGCAGTGACCCTTCTGCTGGAGGGAGTGATG
GCAGCACGGGGACAACTGGGACCCACTTGCCTCTCATCCCTCCTGGGGCAGCTTTCTGGACAGGTCCGTCTCCTC
CTTGGGGCCCTGCAGAGCCTCCTTGGAACCCAGCTTCCTCCACAGGGCAGGACCACAGCTCACAAGGATCCCAAT
GCCATCTTCCTGAGCTTCCAACACCTGCTCCGAGGAAAGGTGCGTTTCCTGATGCTTGTAGGAGGGTCCACCCTC
TGCGTCAGGGAATTCGGCGGCAACATGGCGTCTCCCGCTCCGCCTGCTTGTGACCTCCGAGTCCTCAGTAAACTG
CTTCGTGACTCCCATGTCCTTCACAGCAGACTGAGCCAGTGCCCAGAGGTTCACCCTTTGCCTACACCTGTCCTG
CTGCCTGCTGTGGACTTTAGCTTGGGAGAATGGAAAACCCAGATGGAGGAGACCAAGGCACAGGACATTCTGGGA
GCAGTGACCCTTCTGCTGGAGGGAGTGATGGCAGCACGGGGACAACTGGGACCCACTTGCCTCTCATCCCTCCTG
GGGCAGCTTTCTGGACAGGTCCGTCTCCTCCTTGGGGCCCTGCAGAGCCTCCTTGGAACCCAGGGCAGGACCACA
GCTCACAAGGATCCCAATGCCATCTTCCTGAGCTTCCAACACCTGCTCCGAGGAAAGGTGCGTTTCCTGATGCTT
GTAGGAGGGTCCACCCTCTGCGTCAGG SEQ ID NO:3 pMON28500

TCCCCAGCTCCACCTGCTTGTGACCTCCGAGTCCTCAGTAAACTGCTTCGTGACTCCCATGTCCTTCACAGCAGA
CTGAGCCAGTGCCCAGAGGTTCACCCTTTGCCTACACCTGTCCTGCTGCCTGCTGTGGACTTTAGCTTGGGAGAA
TGGAAAACCCAGATGGAGGAGACCAAGGCACAGGACATTCTGGGAGCAGTGACCCTTCTGCTGGAGGGAGTGATG
GCAGCACGGGGACAACTGGGACCCACTTGCCTCTCATCCCTCCTGGGGCAGCTTTCTGGACAGGTCCGTCTCCTC
CTTGGGGCCCTGCAGAGCCTCCTTGGAACCCAGCTTCCTCCACAGGGCAGGACCACAGCTCACAAGGATCCCAAT
GCCATCTTCCTGAGCTTCCAACACCTGCTCCGAGGAAAGGTGCGTTTCCTGATGCTTGTAGGAGGGTCCACCCTC
TGCGTCAGGGAATTCGGCAACATGGCGTCTCCCGCTCCGCCTGCTTGTGACCTCCGAGTCCTCAGTAAACTGCTT
CGTGACTCCCATGTCCTTCACAGCAGACTGAGCCAGTGCCCAGAGGTTCACCCTTTGCCTACACCTGTCCTGCTG
CCTGCTGTGGACTTTAGCTTGGGAGAATGGAAAACCCAGATGGAGGAGACCAAGGCACAGGACATTCTGGAGCA
GTGACCCTTCTGCTGGAGGGAGTGATGGCAGCACGGGGACAACTGGGACCCACTTGCCTCTCATCCCTCCTGGGG
CAGCTTTCTGGACAGGTCCGTCTCCTCCTTGGGGCCCTGCAGAGCCTCCTTGGAACCCAGCTTCCTCCACAGGGC
AGGACCACAGCTCACAAGGATCCCAATGCCATCTTCCTGAGCTTCCAACACCTGCTCCGAGGAAAGGTGCGTTTC
CTGATGCTTGTAGGAGGGTCCACCCTCTGCGTCAGG SEQ ID NO:4 pMON28501

TCCCCAGCTCCACCTGCTTGTGACCTCCGAGTCCTCAGTAAACTGCTTCGTGACTCCCATGTCCTTCACAGCAGA
CTGAGCCAGTGCCCAGAGGTTCACCCTTTGCCTACACCTGTCCTGCTGCCTGCTGTGGACTTTAGCTTGGGAGAA
TGGAAAACCCAGATGGAGGAGACCAAGGCACAGGACATTCTGGGAGCAGTGACCCTTCTGCTGGAGGGAGTGATG

TABLE 2-continued

GENE SEQUENCES

GCAGCACGGGGACAACTGGGACCCACTTGCCTCTCATCCCTCCTGGGGCAGCTTTCTGGACAGGTCCGTCTCCTC
CTTGGGGCCCTGCAGAGCCTCCTTGGAACCCAGCTTCCTCCACAGGGCAGGACCACAGCTCACAAGGATCCCAAT
GCCATCTTCCTGAGCTTCCAACACCTGCTCCGAGGAAAGGTGCGTTTCCTGATGCTTGTAGGAGGGTCCACCCTC
TGCGTCAGGGAATTCGGCGGCAACATGGCGTCTCCCGCTCCGCCTGCTTGTGACCTCCGAGTCCTCAGTAAACTG
CTTCGTGACTCCCATGTCCTTCACAGCAGACTGAGCCAGTGCCCAGAGGTTCACCCTTTGCCTACACCTGTCCTG
CTGCCTGCTGTGGACTTTAGCTTGGGAGAATGGAAAACCCAGATGGAGGAGACCAAGGCACAGGACATTCTGGGA
GCAGTGACCCTTCTGCTGGAGGGAGTGATGGCAGCACGGGGACAACTGGGACCCACTTGCCTCTCATCCCTCCTG
GGGCAGCTTTCTGGACAGGTCCGTCTCCTCCTTGGGGCCCTGCAGAGCCTCCTTGGAACCCAGCTTCCTCCACAG
GGCAGGACCACAGCTCACAAGGATCCCAATGCCATCTTCCTGAGCTTCCAACACCTGCTCCGAGGAAAGGTGCGT
TTCCTGATGCTTGTAGGAGGGTCCACCCTCTGCGTCAGG SEQ ID NO:5
pMON28502

TCCCCAGCGCCGCCTGCTTGTGACCTCCGAGTCCTCAGTAAACTGCTTCGTGACTCCCATGTCCTTCACAGCAGA
CTGAGCCAGTGCCCAGAGGTTCACCCTTTGCCTACACCTGTCCTGCTGCTGTGGACTTTAGCTTGGGAGAA
TGGAAAACCCAGATGGAGGAGACCAAGGCACAGGACATTCTGGGAGCAGTGACCCTTCTGCTGGAGGGAGTGATG
GCAGCACGGGGACAACTGGGACCCACTTGCCTCTCATCCCTCCTGGGGCAGCTTTCTGGACAGGTCCGTCTCCTC
CTTGGGGCCCTGCAGAGCCTCCTTGGAACCCAGCTTCCTCCACAGGGCAGGACCACAGCTCACAAGGATCCCAAT
GCCATCTTCCTGAGCTTCCAACACCTGCTCCGAGGAAAGGTGCGTTTCCTGATGCTTGTAGGAGGGTCCACCCTC
TGCGTCAGGGAATTCGGCGGCAACGGCGGCAACATGGCGTCCCAGCCGCCGCCTGCTTGTGACCTCCGAGTCCTC
AGTAAACTGCTTCGTGACTCCCATGTCCTTCACAGCAGACTGAGCCAGTGCCCAGAGGTTCACCCTTTGCCTACA
CCTGTCCTGCTGCCTGCTGTGGACTTTAGCTTGGGAGAATGGAAAACCCAGATGGAGGAGACCAAGGCACAGGAC
ATTCTGGGAGCAGTGACCCTTCTGCTGGAGGGAGTGATGGCAGCACGGGGACAACTGGGACCCACTTGCCTCTCA
TCCCTCCTGGGGCAGCTTTCTGGACAGGTCCGTCTCCTCCTTGGGGCCCTGCAGAGCCTCCTTGGAACCCAGCTT
CCTCCACAGGGCAGGACCACAGCTCACAAGGATCCCAATGCCATCTTCCTGAGCTTCCAACACCTGCTCCGAGGA
AAGGTGCGTTTCCTGATGCTTGTAGGAGGGTCCACCCTCTGCGTCAGG
SEQ ID NO:6
Syntan1

```
  1 CATGGCTAAC TGCTCTATAA TGATCGATGA AATTATACAT CACTTAAAGA
 51 GACCACCTGC ACCTTTGCTG GACCCGAACA ACCTCAATGA CGAAGACGTC
101 TCTATCCTGA TGGACCGAAA CCTTCGACTT CCAAACCTGG AGAGCTTCGT
151 AAGGGCTGTC AAGAACTTAG AAAATGCATC AGGTATTGAG GCAATTCTTC
201 GTAATCTCCA ACCATGTCTG CCCTCTGCCA CGGCCGCACC CTCTCGACAT
251 CCAATCATCA TCAAGGCAGG TGACTGGCAA GAATTCCGGG AAAAACTGAC
301 GTTCTATCTG GTTACCCTTG AGCAAGCGCA GGAACAACAG GGTGGTGGCT
351 CTAACTGCTC TATAATGATC GATGAAATTA TACATCACTT AAAGAGACCA
401 CCTGCACCTT TGCTGGACCC GAACAACCTC AATGACGAAG ACGTCTCTAT
451 CCTGATGGAC CGAAACCTTC GACTTCCAAA CCTGGAGAGC TTCGTAAGGG
501 CTGTCAAGAA CTTAGAAAAT GCATCAGGTA TTGAGGCAAT TCTTCGTAAT
551 CTCCAACCAT GTCTGCCCTC TGCCACGGCC GCACCCTCTC GACATCCAAT
601 CATCATCAAG GCAGGTGACT GGCAAGAATT CCGGGAAAAA CTGACGTTCT
651 ATCTGGTTAC CCTTGAGCAA GCGCAGGAAC AACAGTAC SEQ ID NO:7
```
Syntan3

```
  1 CATGGCTAAC TGCTCTATAA TGATCGATGA AATTATACAT CACTTAAAGA
 51 GACCACCTGC ACCTTTGCTG GACCCGAACA ACCTCAATGA CGAAGACGTC
101 TCTATCCTGA TGGACCGAAA CCTTCGACTT CCAAACCTGG AGAGCTTCGT
151 AAGGGCTGTC AAGAACTTAG AAAATGCATC AGGTATTGAG GCAATTCTTC
201 GTAATCTCCA ACCATGTCTG CCCTCTGCCA CGGCCGCACC CTCTCGACAT
251 CCAATCATCA TCAAGGCAGG TGACTGGCAA GAATTCCGGG AAAAACTGAC
301 GTTCTATCTG GTTACCCTTG AGCAAGCGCA GGAACAACAG GGTGGTGGCT
351 CTGGCGGTGG CAGCGGCGGC GGTTCTAACT GCTCTATAAT GATCGATGAA
401 ATTATACATC ACTTAAAGAG ACCACCTGCA CCTTTGCTGG ACCCGAACAA
451 CCTCAATGAC GAAGACGTCT CTATCCTGAT GGACCGAAAC CTTCGACTTC
501 CAAACCTGGA GAGCTTCGTA AGGGCTGTCA AGAACTTAGA AAATGCATCA
551 GGTATTGAGG CAATTCTTCG TAATCTCCAA CCATGTCTGC CCTCTGCCAC
601 GGCCGCACCC TCTCGACATC CAATCATCAT CAAGGCAGGT GACTGGCAAG
651 AATTCCGGGA AAAACTGACG TTCTATCTGG TTACCCTTGA GCAAGCGCAG
701 GAACAACAGT AC SEQ ID NO:8
```
pMON31104

```
  1 ATGGCTCTGG ACCCGAACAA CCTCAATGAC GAAGACGTCT CTATCCTGAT
 51 GGACCGAAAC CTTCGACTTC CAAACCTGGA GAGCTTCGTA AGGGCTGTCA
101 AGAACTTAGA AAATGCATCA GGTATTGAGG CAATTCTTCG TAATCTCCAA
151 CCATGTCTGC CCTCTGCCAC GGCCGCACCC TCTCGACATC CAATCATCAT
201 CAAGGCAGGT GACTGGCAAG AATTCCGGGA AAAACTGACG TTCTATCTGG
251 TTACCCTTGA GCAAGCGCAG GAACAACAGG GTGGTGGCTC TAACTGCTCT
301 ATAATGATCG ATGAAATTAT ACATCACTTA AAGAGACCAC CTGCACCTTT
351 GTACGTAGAG GGCGGTGGAG GCTCCCCGGG TGAACCGTCT GGTCCAATCT
401 CTACTATCAA CCCGTCTCCT CCGTCTAAAG AATCTCATAA ATCTCCAAAC
451 ATGGCTACCC AGGGTGCCAT GCCGGCCTTC GCCTCTGCTT TCCAGCGCCG
501 GGCAGGAGGG GTCCTGGTTG CTAGCCATCT GCAGAGCTTC CTGGAGGTGT
551 CGTACCGCGT TCTACGCCAC CTTGCGCAGC CCTCTGGCCG CTCTGGCGGC
601 TCTCAGAGCT TCCTGCTCAA GTCTTTGAGG CAAGTGAGAA AGATCAGGGC
651 CGATGGCGCA GCGCTCCAGG AGAAGCTGTG TGCCACCTAC AAGCTGTGCC
701 ACCCCGAGGA GCTGGTGCTG CTCGGACACT CTCTGGGCAT CCCCTGGGCT
751 CCCCTGAGCT CCTGCCCCAG CCAGGCCCTG CAGCTGGCAG GCTGCTTGAG
```

TABLE 2-continued

GENE SEQUENCES

```
801 CCAACTCCAT AGCGGCCTTT TCCTCTACCA GGGGCTCCTG CAGGCCCTGG
851 AAGGGATATC CCCCGAGTTG GGTCCCACCT TGGACACACT GCAGCTGGAC
901 GTCGCCGACT TGCCACCAC CATCTGGCAG CAGATGGAAG AACTGGGAAT
951 GGCCCCTGCC CTGCAGCCCT AATAA SEQ ID NO:9
```
pMON31105

```
  1 ATGGCTAATG CATCAGGTAT TGAGGCAATT CTTCGTAATC TCCAACCATG
 51 TCTGCCCTCT GCCACGGCCG CACCCTCTCG ACATCCAATC ATCATCAAGG
101 CAGGTGACTG GCAAGAATTC CGGGAAAAAC TGACGTTCTA TCTGGTTACC
151 CTTGAGCAAG CGCAGGAACA ACAGGGTGGT GGCTCTAACT GCTCTATAAT
201 GATCGATGAA ATTATACATC ACTTAAAGAG ACCACCTGCA CCTTTGCTGG
251 ACCCGAACAA CCTCAATGAC GAAGACGTCT CTATCCTGAT GGACCGAAAC
301 CTTCGACTTC CAAACCTGGA GAGCTTCGTA AGGGCTGTCA AGAACTTAGA
351 ATACGTAGAG GGCGGTGGAG GCTCCCCGGG TGAACCGTCT GGTCCAATCT
401 CTACTATCAA CCCGTCTCCT CCGTCTAAAG AATCTCATAA ATCTCCAAAC
451 ATGGCTACCC AGGGTGCCAT GCCGGCCTTC GCCTCTGCTT TCCAGCGCCG
501 GGCAGGAGGG GTCCTGGTTG CTAGCCATCT GCAGAGCTTC CTGGAGGTGT
551 CGTACCGCGT TCTACGCCAC CTTGCGCAGC CCTCTGGCGG CTCTGGCGGC
601 TCTCAGAGCT TCCTGCTCAA GTCTTTAGAG CAAGTGAGAA AGATCCAGGG
651 CGATGGCGCA GCGCTCCAGG AGAAGCTGTG TGCCACCTAC AAGCTGTGCC
701 ACCCCGAGGA GCTGGTGCTG CTCGGACACT CTCTGGGCAT CCCCTGGGCT
751 CCCCTGAGCT CCTGCCCCAG CCAGGCCCTG CAGCTGGCAG GCTGCTTGAG
801 CCAACTCCAT AGCGGCCTTT TCCTCTACCA GGGGCTCCTG CAGGCCCTGG
851 AAGGGATATC CCCCGAGTTG GGTCCCACCT TGGACACACT GCAGCTGGAC
901 GTCGCCGACT TGCCACCAC CATCTGGCAG CAGATGGAAG AACTGGGAAT
951 GGCCCCTGCC CTGCAGCCCT AATAA SEQ ID NO:10
```
pMON31106

```
  1 ATGGCTGCAC CCTCTCGACA TCCAATCATC ATCAAGGCAG GTGACTGGCA
 51 AGAATTCCGG GAAAAACTGA CGTTCTATCT GGTTACCCTT GAGCAAGCGC
101 AGGAACAACA GGGTGGTGGC TCTAACTGCT CTATAATGAT CGATGAAATT
151 ATACATCACT TAAAGAGACC ACCTGCACCT TTGCTGGACC CGAACAACCT
201 CAATGACGAA GACGTCTCTA TCCTGATGGA CCGAAACCTT CGACTTCCAA
251 ACCTGGAGAG CTTCGTAAGG GCTGTCAAGA ACTTAGAAAA TGCATCAGGT
301 ATTGAGGCAA TTCTTCGTAA TCTCCAACCA TGTCTGCCCT CTGCCACGGC
351 CTACGTAGAG GGCGGTGGAG GCTCCCCGGG TGAACCGTCT GGTCCAATCT
401 CTACTATCAA CCCGTCTCCT CCGTCTAAAG AATCTCATAA ATCTCCAAAC
451 ATGGCTACCC AGGGTGCCAT GCCGGCCTTC GCCTCTGCTT TCCAGCGCCG
501 GGCAGGAGGG GTCCTGGTTG CTAGCCATCT GCAGAGCTTC CTGGAGGTGT
551 CGTACCGCGT TCTACGCCAC CTTGCGCAGC CCTCTGGCGG CTCTGGCGGC
601 TCTCAGAGCT TCCTGCTCAA GTCTTTAGAG CAAGTGAGAA AGATCCAGGG
651 CGATGGCGCA GCGCTCCAGG AGAAGCTGTG TGCCACCTAC AAGCTGTGCC
701 ACCCCGAGGA GCTGGTGCTG CTCGGACACT CTCTGGGCAT CCCCTGGGCT
751 CCCCTGAGCT CCTGCCCCAG CCAGGCCCTG CAGCTGGCAG GCTGCTTGAG
801 CCAACTCCAT AGCGGCCTTT TCCTCTACCA GGGGCTCCTG CAGGCCCTGG
851 AAGGGATATC CCCCGAGTTG GGTCCCACCT TGGACACACT GCAGCTGGAC
901 GTCGCCGACT TGCCACCAC CATCTGGCAG CAGATGGAAG AACTGGGAAT
951 GGCCCCTGCC CTGCAGCCCT AATAA SEQ ID NO:11
```
pMON31107

```
  1 ATGGCTGCAG GTGACTGGCA AGAATTCCGG GAAAAACTGA CGTTCTATCT
 51 GGTTACCCTT GAGCAAGCGC AGGAACAACA GGGTGGTGGC TCTAACTGCT
101 CTATAATGAT CGATGAAATT ATACATCACT TAAAGAGACC ACCTGCACCT
151 TTGCTGGACC CGAACAACCT CAATGACGAA GACGTCTCTA TCCTGATGGA
201 CCGAAACCTT CGACTTCCAA ACCTGGAGAG CTTCGTAAGG GCTGTCAAGA
251 ACTTAGAAAA TGCATCAGGT ATTGAGGCAA TTCTTCGTAA TCTCCAACCA
301 TGTCTGCCCT CTGCCACGGC CGCACCCTCT CGACATCCAA TCATCATCAA
351 GTACGTAGAG GGCGGTGGAG GCTCCCCGGG TGAACCGTCT GGTCCAATCT
401 CTACTATCAA CCCGTCTCCT CCGTCTAAAG AATCTCATAA ATCTCCAAAC
451 ATGGCTACCC AGGGTGCCAT GCCGGCCTTC GCCTCTGCTT TCCAGCGCCG
501 GGCAGGAGGG GTCCTGGTTG CTAGCCATCT GCAGAGCTTC CTGGAGGTGT
551 CGTACCGCGT TCTACGCCAC CTTGCGCAGC CCTCTGGCGG CTCTGGCGGC
601 TCTCAGAGCT TCCTGCTCAA GTCTTTAGAG CAAGTGAGAA AGATCCAGGG
651 CGATGGCGCA GCGCTCCAGG AGAAGCTGTG TGCCACCTAC AAGCTGTGCC
701 ACCCCGAGGA GCTGGTGCTG CTCGGACACT CTCTGGGCAT CCCCTGGGCT
751 CCCCTGAGCT CCTGCCCCAG CCAGGCCCTG CAGCTGGCAG GCTGCTTGAG
801 CCAACTCCAT AGCGGCCTTT TCCTCTACCA GGGGCTCCTG CAGGCCCTGG
851 AAGGGATATC CCCCGAGTTG GGTCCCACCT TGGACACACT GCAGCTGGAC
901 GTCGCCGACT TGCCACCAC CATCTGGCAG CAGATGGAAG AACTGGGAAT
951 GGCCCCTGCC CTGCAGCCCT AATAA SEQ ID NO:12
```
pMON31108

```
  1 ATGGCTCTGG ACCCGAACAA CCTCAATGAC GAAGACGTCT CTATCCTGAT
 51 GGACCGAAAC CTTCGACTTC CAAACCTGGA GAGCTTCGTA AGGGCTGTCA
101 AGAACTTAGA AAATGCATCA GGTATTGAGG CAATTCTTCG TAATCTCCAA
151 CCATGTCTGC CCTCTGCCAC GGCCGCACCC TCTCGACATC CAATCATCAT
201 CAAGGCAGGT GACTGGCAAG AATTCCGGGA AAAACTGACG TTCTATCTGG
```

TABLE 2-continued

GENE SEQUENCES

```
251 TTACCCTTGA GCAAGCGCAG GAACAACAGG GTGGTGGCTC TGGCGGTGGC
301 AGCGGCGGCG GTTCTAACTG CTCTATAATG ATCGATGAAA TTATACATCA
351 CTTAAAGAGA CCACCTGCAC CTTTGTACGT AGAGGGCGGT GGAGGCTCCC
401 CGGGTGAACC GTCTGGTCCA ATCTCTACTA TCAACCCGTC TCCTCCGTCT
451 AAAGAATCTC ATAAATCTCC AAACATGGCT ACCCAGGGTG CCATGCCGGC
501 CTTCGCCTCT GCTTTCCAGC GCCGGGCAGG AGGGGTCCTG GTTGCTAGCC
551 ATCTGCAGAG CTTCCTGGAG GTGTCGTACC GCGTTCTACG CCACCTTGCG
601 CAGCCCTCTG GCGGCTCTGG CGGCTCTCAG AGCTTCCTGC TCAAGTCTTT
651 AGAGCAAGTG AGAAAGATCC AGGGCGATGG CGCAGCGCTC CAGGAGAAGC
701 TGTGTGCCAC CTACAAGCTG TGCCACCCCG AGGAGCTGGT GCTGCTCGGA
751 CACTCTCTGG GCATCCCCTG GCTCCCCTG AGCTCCTGCC CCAGCCAGGC
801 CCTGCAGCTG GCAGGCTGCT TGAGCCAACT CCATAGCGGC CTTTTCCTCT
851 ACCAGGGGCT CCTGCAGGCC CTGGAAGGGA TATCCCCCGA GTTGGGTCCC
901 ACCTTGGACA CACTGCAGCT GGACGTCGCC GACTTTGCCA CCACCATCTG
951 GCAGCAGATG GAAGAACTGG GAATGGCCCC TGCCCTGCAG CCCTAATAA
        SEQ ID NO:13
pMON31109

1 ATGGCTAATG CATCAGGTAT TGAGGCAATT CTTCGTAATC TCCAACCATG
 51 TCTGCCCTCT GCCACGGCCG CACCCTCTCG ACATCCAATC ATCATCAAGG
101 CAGGTGACTG GCAAGAATTC CGGGAAAAAC TGACGTTCTA TCTGGTTACC
151 CTTGAGCAAG CGCAGGAACA ACAGGGTGGT GGCTCTGGCG GTGGCAGCGG
201 CGGCGGTTCT AACTGCTCTA TAATGATCGA TGAAATTATA CATCACTTAA
251 AGAGACCACC TGCACCTTTG CTGGACCCGA ACAACCTCAA TGACGAAGAC
301 GTCTCTATCC TGATGGACCG AAACCTTCGA CTTCCAAACC TGGAGAGCTT
351 CGTAAGGGCT GTCAAGAACT TAGAATACGT AGAGGGCGGT GGAGGCTCCC
401 CGGGTGAACC GTCTGGTCCA ATCTCTACTA TCAACCCGTC TCCTCCGTCT
451 AAAGAATCTC ATAAATCTCC AAACATGGCT ACCCAGGGTG CCATGCCGGC
501 CTTCGCCTCT GCTTTCCAGC GCCGGGCAGG AGGGGTCCTG GTTGCTAGCC
551 ATCTGCAGAG CTTCCTGGAG GTGTCGTACC GCGTTCTACG CCACCTTGCG
601 CAGCCCTCTG GCGGCTCTGG CGGCTCTCAG AGCTTCCTGC TCAAGTCTTT
651 AGAGCAAGTG AGAAAGATCC AGGGCGATGG CGCAGCGCTC CAGGAGAAGC
701 TGTGTGCCAC CTACAAGCTG TGCCACCCCG AGGAGCTGGT GCTGCTCGGA
751 CACTCTCTGG GCATCCCCTG GCTCCCCTG AGCTCCTGCC CCAGCCAGGC
801 CCTGCAGCTG GCAGGCTGCT TGAGCCAACT CCATAGCGGC CTTTTCCTCT
851 ACCAGGGGCT CCTGCAGGCC CTGGAAGGGA TATCCCCCGA GTTGGGTCCC
901 ACCTTGGACA CACTGCAGCT GGACGTCGCC GACTTTGCCA CCACCATCTG
951 GCAGCAGATG GAAGAACTGG GAATGGCCCC TGCCCTGCAG CCCTAATAA
        SEQ ID NO:14
pMON31110

1 ATGGCTGCAC CCTCTCGACA TCCAATCATC ATCAAGGCAG GTGACTGGCA
 51 AGAATTCCGG GAAAAACTGA CGTTCTATCT GGTTACCCTT GAGCAAGCGC
101 AGGAACAACA GGGTGGTGGC TCTGGCGGTG GCAGCGGCGG CGGTTCTAAC
151 TGCTCTATAA TGATCGATGA AATTATACAT CACTTAAAGA GACCACCTGC
201 ACCTTTGCTG GACCCGAACA ACCTCAATGA CGAAGACGTC TCTATCCTGA
251 TGGACCGAAA CCTTCGACTT CCAAACCTGG AGAGCTTCGT AAGGGCTGTC
301 AAGAACTTAG AAAATGCATC AGGTATTGAG GCAATTCTTC GTAATCTCCA
351 ACCATGTCTG CCCTCTGCCA CGGCCTACGT AGAGGGCGGT GGAGGCTCCC
401 CGGGTGAACC GTCTGGTCCA ATCTCTACTA TCAACCCGTC TCCTCCGTCT
451 AAAGAATCTC ATAAATCTCC AAACATGGCT ACCCAGGGTG CCATGCCGGC
501 CTTCGCCTCT GCTTTCCAGC GCCGGGCAGG AGGGGTCCTG GTTGCTAGCC
551 ATCTGCAGAG CTTCCTGGAG GTGTCGTACC GCGTTCTACG CCACCTTGCG
601 CAGCCCTCTG GCGGCTCTGG CGGCTCTCAG AGCTTCCTGC TCAAGTCTTT
651 AGAGCAAGTG AGAAAGATCC AGGGCGATGG CGCAGCGCTC CAGGAGAAGC
701 TGTGTGCCAC CTACAAGCTG TGCCACCCCG AGGAGCTGGT GCTGCTCGGA
751 CACTCTCTGG GCATCCCCTG GCTCCCCTG AGCTCCTGCC CCAGCCAGGC
801 CCTGCAGCTG GCAGGCTGCT TGAGCCAACT CCATAGCGGC CTTTTCCTCT
851 ACCAGGGGCT CCTGCAGGCC CTGGAAGGGA TATCCCCCGA GTTGGGTCCC
901 ACCTTGGACA CACTGCAGCT GGACGTCGCC GACTTTGCCA CCACCATCTG
951 GCAGCAGATG GAAGAACTGG GAATGGCCCC TGCCCTGCAG CCCTAATAA
        SEQ ID NO:15
pMON31111

1 ATGGCTGCAG GTGACTGGCA AGAATTCCGG GAAAAACTGA CGTTCTATCT
 51 GGTTACCCTT GAGCAAGCGC AGGAACAACA GGGTGGTGGC TCTGGCGGTG
101 GCAGCGGCGG CGGTTCTAAC TGCTCTATAA TGATCGATGA AATTATACAT
151 CACTTAAAGA GACCACCTGC ACCTTTGCTG GACCCGAACA ACCTCAATGA
201 CGAAGACGTC TCTATCCTGA TGGACCGAAA CCTTCGACTT CCAAACCTGG
251 AGAGCTTCGT AAGGGCTGTC AAGAACTTAG AAAATGCATC AGGTATTGAG
301 GCAATTCTTC GTAATCTCCA ACCATGTCTG CCCTCTGCCA CGGCCGCACC
351 CTCTCGACAT CCAATCATCA TCAAGTACGT AGAGGGCGGT GGAGGCTCCC
401 CGGGTGAACC GTCTGGTCCA ATCTCTACTA TCAACCCGTC TCCTCCGTCT
451 AAAGAATCTC ATAAATCTCC AAACATGGCT ACCCAGGGTG CCATGCCGGC
501 CTTCGCCTCT GCTTTCCAGC GCCGGGCAGG AGGGGTCCTG GTTGCTAGCC
551 ATCTGCAGAG CTTCCTGGAG GTGTCGTACC GCGTTCTACG CCACCTTGCG
601 CAGCCCTCTG GCGGCTCTGG CGGCTCTCAG AGCTTCCTGC TCAAGTCTTT
```

TABLE 2-continued

GENE SEQUENCES

```
651 AGAGCAAGTG AGAAAGATCC AGGGCGATGG CGCAGCGCTC CAGGAGAAGC
701 TGTGTGCCAC CTACAAGCTG TGCCACCCCG AGGAGCTGGT GCTGCTCGGA
751 CACTCTCTGG GCATCCCCTG GGCTCCCCTG AGCTCCTGCC CCAGCCAGGC
801 CCTGCAGCTG GCAGGCTGCT TGAGCCAACT CCATAGCGGC CTTTTCCTCT
851 ACCAGGGGCT CCTGCAGGCC CTGGAAGGGA TATCCCCCGA GTTGGGTCCC
901 ACCTTGGACA CACTGCAGCT GGACGTCGCC GACTTTGCCA CCACCATCTG
951 GCAGCAGATG GAAGAACTGG GAATGGCCCC TGCCCTGCAG CCCTAATAA
    SEQ ID NO:16
```
pMON13182

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG GTGGTTCTGG CGGCGGCTCC AACATGGCTT
401 ACAAGCTGTG CCACCCCGAG GAGCTGGTGC TGCTCGGACA CTCTCTGGGC
451 ATCCCCTGGG CTCCCCTGAG CTCCTGCCCC AGCCAGGCCC TGCAGCTGGC
501 AGGCTGCTTG AGCCAACTCC ATAGCGGCCT TTTCCTCTAC CAGGGGCTCC
551 TGCAGGCCCT GGAAGGGATA TCCCCCGAGT TGGGTCCCAC CTTGGACACA
601 CTGCAGCTGG ACGTCGCCGA CTTTGCCACC ACCATCTGGC AGCAGATGGA
651 AGAACTGGGA ATGGCCCCTG CCCTGCAGCC CACCCAGGGT GCCATGCCGG
701 CCTTCGCCTC TGCTTTCCAG CGCCGGGCAG GAGGGGTCCT GGTTGCTAGC
751 CATCTGCAGA GCTTCCTGGA GGTGTCGTAC CGCGTTCTAC GCCACCTTGC
801 GCAGCCCTCT GGCGGCTCTG GCGGCTCTCA GAGCTTCCTG CTCAAGTCTT
851 TAGAGCAAGT GAGAAAGATC CAGGGCGATG GCGCAGCGCT CCAGGAGAAG
901 CTGTGTGCCA CCTAATAA SEQ ID NO:17
```
pMON13183

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTTACAAG
451 CTGTGCCACC CCGAGGAGCT GGTGCTGCTC GGACACTCTC TGGGCATCCC
501 CTGGGCTCCC CTGAGCTCCT GCCCCAGCCA GGCCCTGCAG CTGGCAGGCT
551 GCTTGAGCCA ACTCCATAGC GGCCTTTTCC TCTACCAGGG GCTCCTGCAG
601 GCCCTGGAAG GGATATCCCC CGAGTTGGGT CCCACCTTGG ACACACTGCA
651 GCTGGACGTC GCCGACTTTG CCACCACCAT CTGGCAGCAG ATGGAAGAAC
701 TGGGAATGGC CCCTGCCCTG CAGCCCACCC AGGGTGCCAT GCCGGCCTTC
751 GCCTCTGCTT TCCAGCGCCG GGCAGGAGGG GTCCTGGTTG CTAGCCATCT
801 GCAGAGCTTC CTGGAGGTGT CGTACCGCGT TCTACGCCAC CTTGCGCAGC
851 CCTCTGGCGG CTCTGGCGGC TCTCAGAGCT TCCTGCTCAA GTCTTTAGAG
901 CAAGTGAGAA AGATCCAGGG CGATGGCGCA GCGCTCCAGG AGAAGCTGTG
951 TGCCACCTAA TAA SEQ ID NO:18
```
pMON13184

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG GTGGTTCTGG CGGCGGCTCC AACATGGCTC
401 CCGAGTTGGG TCCCACCTTG GACACACTGC AGCTGGACGT CGCCGACTTT
451 GCCACCACCA TCTGGCAGCA GATGGAAGAA CTGGGAATGG CCCCTGCCCT
501 GCAGCCCACC CAGGGTGCCA TGCCGGCCTT CGCCTCTGCT TTCCAGCGCC
551 GGGCAGGAGG GGTCCTGGTT GCTAGCCATC TGCAGAGCTT CCTGGAGGTG
601 TCGTACCGCG TTCTACGCCA CCTTGCGCAG CCCTCTGGCG GCTCTGGCGG
651 CTCTCAGAGC TTCCTGCTCA AGTCTTTAGA GCAAGTGAGA AGATCCAGG
701 GCGATGGCGC AGCGCTCCAG GAGAAGCTGT GTGCCACCTA CAAGCTGTGC
751 CACCCCGAGG AGCTGGTGCT GCTCGGACAC TCTCTGGGCA TCCCCTGGGC
801 TCCCCTGAGC TCCTGCCCCA GCCAGGCCCT GCAGCTGGCA GGCTGCTTGA
851 GCCAACTCCA TAGCGGCCTT TTCCTCTACC AGGGGCTCCT GCAGGCCCTG
901 GAAGGGATAT CCTAATAA SEQ ID NO:19
```
pMON13185

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
```

TABLE 2-continued

GENE SEQUENCES

```
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTCCCGAG
451 TTGGGTCCCA CCTTGGACAC ACTGCAGCTG GACGTCGCCG ACTTTGCCAC
501 CACCATCTGG CAGCAGATGG AAGAACTGGG AATGGCCCCT GCCCTGCAGC
551 CCACCCAGGG TGCCATGCCG GCCTTCGCCT CTGCTTTCCA GCGCCGGGCA
601 GGAGGGGTCC TGGTTGCTAG CCATCTGCAG AGCTTCCTGG AGGTGTCGTA
651 CCGCGTTCTA CGCCACCTTG CGCAGCCCTC TGGCGGCTCT GGCGGCTCTC
701 AGAGCTTCCT GCTCAAGTCT TTAGAGCAAG TGAGAAAGAT CCAGGGCGAT
751 GGCGCAGCGC TCCAGGAGAA GCTGTGTGCC ACCTACAAGC TGTGCCACCC
801 CGAGGAGCTG GTGCTGCTCG GACACTCTCT GGGCATCCCC TGGGCTCCCC
851 TGAGCTCCTG CCCCAGCCAG GCCCTGCAGC TGGCAGGCTG CTTGAGCCAA
901 CTCCATAGCG GCCTTTTCCT CTACCAGGGG CTCCTGCAGG CCCTGGAAGG
951 GATATCCTAA TAA SEQ ID NO:20
``` pMON13186

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG GTGGTTCTGG CGGCGGCTCC AACATGGCTA
401 TGGCCCCTGC CCTGCAGCCC ACCCAGGGTG CCATGCCGGC CTTCGCCTCT
451 GCTTTCCAGC GCCGGGCAGG AGGGGTCCTG GTTGCTAGCC ATCTGCAGAG
501 CTTCCTGGAG GTGTCGTACC GCGTTCTACG CCACCTTGCG CAGCCCTCTG
551 GCGGCTCTGG CGGCTCTCAG AGCTTCCTGC TCAAGTCTTT AGAGCAAGTG
601 AGAAAGATCC AGGGCGATGG CGCAGCGCTC CAGGAGAAGC TGTGTGCCAC
651 CTACAAGCTG TGCCACCCCG AGGAGCTGGT GCTGCTCGGA CACTCTCTGG
701 GCATCCCCTG GGCTCCCCTG AGCTCCTGCC CCAGCCAGGC CCTGCAGCTG
751 GCAGGCTGCT TGAGCCAACT CCATAGCGGC CTTTTCCTCT ACCAGGGGCT
801 CCTGCAGGCC CTGGAAGGGA TATCCCCCGA GTTGGGTCCC ACCTTGGACA
851 CACTGCAGCT GGACGTCGCC GACTTTGCCA CCACCATCTG GCAGCAGATG
901 GAAGAACTGG GATAATAA SEQ ID NO:21
``` pMON13187

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTATGGCC
451 CCTGCCCTGC AGCCCACCCA GGGTGCCATG CCGGCCTTCG CCTCTGCTTT
501 CCAGCGCCGG GCAGGAGGGG TCCTGGTTGC TAGCCATCTG CAGAGCTTCC
551 TGGAGGTGTC GTACCGCGTT CTACGCCACC TTGCGCAGCC CTCTGGCGGC
601 TCTGGCGGCT CTCAGAGCTT CCTGCTCAAG TCTTTAGAGC AAGTGAGAAA
651 GATCCAGGGC GATGGCGCAG CGCTCCAGGA GAAGCTGTGT GCCACCTACA
701 AGCTGTGCCA CCCCGAGGAG CTGGTGCTGC TCGGACACTC TCTGGGCATC
751 CCCTGGGCTC CCCTGAGCTC CTGCCCCAGC CAGGCCCTGC AGCTGGCAGG
801 CTGCTTGAGC CAACTCCATA GCGGCCTTTT CCTCTACCAG GGGCTCCTGC
851 AGGCCCTGGA AGGGATATCC CCCGAGTTGG GTCCCACCTT GGACACACTG
901 CAGCTGGACG TCGCCGACTT TGCCACCACC ATCTGGCAGC AGATGGAAGA
951 ACTGGGATAA TAA SEQ ID NO:22
``` pMON13188

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG GTGGTTCTGG CGGCGGCTCC AACATGGCTA
401 CCCAGGGTGC CATGCCGGCC TTCGCCTCTG CTTTCCAGCG CCGGGCAGGA
451 GGGGTCCTGG TTGCTAGCCA TCTGCAGAGC TTCCTGGAGG TGTCGTACCG
501 CGTTCTACGC CACCTTGCGC AGCCCTCTGG CGGCTCTGGC GGCTCTCAGA
551 GCTTCCTGCT CAAGTCTTTA GAGCAAGTGA GAAAGATCCA GGGCGATGGC
601 GCAGCGCTCC AGGAGAAGCT GTGTGCCACC TACAAGCTGT GCCACCCCGA
651 GGAGCTGGTG CTGCTCGGAC ACTCTCTGGG CATCCCCTGG GCTCCCCTGA
701 GCTCCTGCCC CAGCCAGGCC CTGCAGCTGG CAGGCTGCTT GAGCCAACTC
```

TABLE 2-continued

GENE SEQUENCES

```
751 CATAGCGGCC TTTTCCTCTA CCAGGGGCTC CTGCAGGCCC TGGAAGGGAT
801 ATCCCCGAG TTGGGTCCCA CCTTGGACAC ACTGCAGCTG GACGTCGCCG
851 ACTTTGCCAC CACCATCTGG CAGCAGATGG AAGAACTGGG AATGGCCCCT
901 GCCCTGCAGC CCTAATAA SEQ ID NO:23
```
pMON13189

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTACCCAG
451 GGTGCCATGC CGGCCTTCGC CTCTGCTTTC CAGCGCCGGG CAGGAGGGGT
501 CCTGGTTGCT AGCCATCTGC AGAGCTTCCT GGAGGTGTCG TACCGCGTTC
551 TACGCCACCT TGCGCAGCCC TCTGGCGGCT CTGGCGGCTC TCAGAGCTTC
601 CTGCTCAAGT CTTTAGAGCA AGTGAGAAAG ATCCAGGGCG ATGGCGCAGC
651 GCTCCAGGAG AAGCTGTGTG CCACCTACAA GCTGTGCCAC CCCGAGGAGC
701 TGGTGCTGCT CGGACACTCT CTGGGCATCC CTGGGCTCC CCTGAGCTCC
751 TGCCCCAGCC AGGCCCTGCA GCTGGCAGGC TGCTTGAGCC AACTCCATAG
801 CGGCCTTTTC CTCTACCAGG GGCTCCTGCA GGCCCTGGAA GGGATATCCC
851 CCGAGTTGGG TCCCACCTTG GACACACTGC AGCTGGACGT CGCCGACTTT
901 GCCACCACCA TCTGGCAGCA GATGGAAGAA CTGGGAATGG CCCCTGCCCT
951 GCAGCCCTAA TAA SEQ ID NO:24
```
pMON13190

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG GTGGTTCTGG CGGCGGCTCC AACATGGCTT
401 CTGCTTTCCA GCGCCGGGCA GGAGGGGTCC TGGTTGCTAG CCATCTGCAG
451 AGCTTCCTGG AGGTGTCGTA CCGCGTTCTA CGCCACCTTG CGCAGCCCTC
501 TGGCGGCTCT GGCGGCTCTC AGAGCTTCCT GCTCAAGTCT TTAGAGCAAG
551 TGAGAAAGAT CCAGGGCGAT GGCGCAGCGC TCCAGGAGAA GCTGTGTGCC
601 ACCTACAAGC TGTGCCACCC CGAGGAGCTG GTGCTGCTCG GACACTCTCT
651 GGGCATCCCC TGGGCTCCCC TGAGCTCCTG CCCCAGCCAG GCCCTGCAGC
701 TGGCAGGCTG CTTGAGCCAA CTCCATAGCG GCCTTTTCCT CTACCAGGGG
751 CTCCTGCAGG CCCTGGAAGG GATATCCCCC GAGTTGGGTC CCACCTTGGA
801 CACACTGCAG CTGGACGTCG CCGACTTTGC CACCACCATC TGGCAGCAGA
851 TGGAAGAACT GGGAATGGCC CCTGCCCTGC AGCCCACCCA GGGTGCCATG
901 CCGGCCTTCG CCTAATAA SEQ ID NO:25
```
pMON13191

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTTCTGCT
451 TTCCAGCGCC GGGCAGGAGG GGTCCTGGTT GCTAGCCATC TGCAGAGCTT
501 CCTGGAGGTG TCGTACCGCG TTCTACGCCA CCTTGCGCAG CCCTCTGGCG
551 GCTCTGGCGG CTCTCAGAGC TTCCTGCTCA AGTCTTTAGA GCAAGTGAGA
601 AAGATCCAGG GCGATGGCGC AGCGCTCCAG GAGAAGCTGT GTGCCACCTA
651 CAAGCTGTGC CACCCCGAGG AGCTGGTGCT GCTCGGACAC TCTCTGGGCA
701 TCCCCTGGGC TCCCCTGAGC TCCTGCCCCA GCCAGGCCCT GCAGCTGGCA
751 GGCTGCTTGA GCCAACTCCA TAGCGGCCTT TTCCTCTACC AGGGGCTCCT
801 GCAGGCCCTG GAAGGGATAT CCCCCGAGTT GGGTCCCACC TTGGACACAC
851 TGCAGCTGGA CGTCGCCGAC TTTGCCACCA CCATCTGGCA GCAGATGGAA
901 GAACTGGGAA TGGCCCCTGC CCTGCAGCCC ACCCAGGGTG CCATGCCGGC
951 CTTCGCCTAA TAA SEQ ID NO:26
```
pMON13192

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
```

TABLE 2-continued

GENE SEQUENCES

```
301 TTCTATCTGG TTACCCTTGA GCAAGCGCAG GAACAACAGT ACGTAGAGGG
351 CGGTGGAGGC TCCCCGGGTG GTGGTTCTGG CGGCGGCTCC AACATGGCTT
401 ACAAGCTGTG CCACCCCGAG GAGCTGGTGC TGCTCGGACA CTCTCTGGGC
451 ATCCCCTGGG CTCCCCTGAG CTCCTGCCCC AGCCAGGCCC TGCAGCTGGC
501 AGGCTGCTTG AGCCAACTCC ATAGCGGCCT TTTCCTCTAC CAGGGGCTCC
551 TGCAGGCCCT GGAAGGGATA TCCCCCGAGT TGGGTCCCAC CTTGGACACA
601 CTGCAGCTGG ACGTCGCCGA CTTTGCCACC ACCATCTGGC AGCAGATGGA
651 AGAACTGGGA ATGGCCCCTG CCCTGCAGCC CACCCAGGGT GCCATGCCGG
701 CCTTCGCCTC TGCTTTCCAG CGCCGGGCAG GAGGGGTCCT GGTTGCTAGC
751 CATCTGCAGA GCTTCCTGGA GGTGTCGTAC CGCGTTCTAC GCCACCTTGC
801 GCAGCCCACA CCATTGGGCC CTGCCAGCTC CCTGCCCCAG AGCTTCCTGC
851 TCAAGTCTTT AGAGCAAGTG AGAAAGATCC AGGGCGATGG CGCAGCGCTC
901 CAGGAGAAGC TGTGTGCCAC CTAATAA SEQ ID NO:27
```
pMON13193

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTTACAAG
451 CTGTGCCACC CCGAGGAGCT GGTGCTGCTC GGACACTCTC TGGGCATCCC
501 CTGGGCTCCC CTGAGCTCCT GCCCCAGCCA GGCCCTGCAG CTGGCAGGCT
551 GCTTGAGCCA ACTCCATAGC GGCCTTTTCC TCTACCAGGG GCTCCTGCAG
601 GCCCTGGAAG GGATATCCCC CGAGTTGGGT CCCACCTTGG ACACACTGCA
651 GCTGGACGTC GCCGACTTTG CCACCACCAT CTGGCAGCAG ATGGAAGAAC
701 TGGGAATGGC CCCTGCCCTG CAGCCCACCC AGGGTGCCAT GCCGGCCTTC
751 GCCTCTGCTT TCCAGCGCCG GGCAGGAGGG GTCCTGGTTG CTAGCCATCT
801 GCAGAGCTTC CTGGAGGTGT CGTACCGCGT TCTACGCCAC CTTGCGCAGC
851 CCACACCATT GGGCCCTGCC AGCTCCCTGC CCAGAGCTT CCTGCTCAAG
901 TCTTTAGAGC AAGTGAGAAA GATCCAGGGC GATGGCGCAG CGCTCCAGGA
951 GAAGCTGTGT GCCACCTAAT AA SEQ ID NO:28
```
pMON25190

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG GTGGTTCTGG CGGCGGCTCC AACATGGCTC
401 CCGAGTTGGG TCCCACCTTG GACACACTGC AGCTGGACGT CGCCGACTTT
451 GCCACCACCA TCTGGCAGCA GATGGAAGAA CTGGGAATGG CCCCTGCCCT
501 GCAGCCCACC CAGGGTGCCA TGCCGGCCTT CGCCTCTGCT TTCCAGCGCC
551 GGGCAGGAGG GGTCCTGGTT GCTAGCCATC TGCAGAGCTT CCTGGAGGTG
601 TCGTACCGCG TTCTACGCCA CCTTGCGCAG CCCACACCAT GGGCCCTGC
651 CAGCTCCCTG CCCAGAGCT TCCTGCTCAA GTCTTTAGAG CAAGTGAGAA
701 AGATCCAGGG CGATGGCGCA GCGCTCCAGG AGAAGCTGTG TGCCACCTAC
751 AAGCTGTGCC ACCCCGAGGA GCTGGTGCTG CTCGGACACT CTCTGGGCAT
801 CCCCTGGGCT CCCCTGAGCT CCTGCCCCAG CCAGGCCCTG CAGCTGGCAG
851 GCTGCTTGAG CCAACTCCAT AGCGGCCTTT TCCTCTACCA GGGGCTCCTG
901 CAGGCCCTGG AAGGGATATC CTAATAA SEQ ID NO:29
```
pMON25191

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTCCCGAG
451 TTGGGTCCCA CCTTGGACAC ACTGCAGCTG GACGTCGCCG ACTTTGCCAC
501 CACCATCTGG CAGCAGATGG AAGAACTGGG AATGGCCCCT GCCCTGCAGC
551 CCACCCAGGG TGCCATGCCG GCCTTCGCCT CTGCTTTCCA GCGCCGGGCA
601 GGAGGGGTCC TGGTTGCTAG CCATCTGCAG AGCTTCCTGG AGGTGTCGTA
651 CCGCGTTCTA CGCCACCTTG CGCAGCCCAC ACCATTGGGC CCTGCCAGCT
701 CCCTGCCCCA GAGCTTCCTG CTCAAGTCTT TAGAGCAAGT GAGAAAGATC
751 CAGGGCGATG GCGCAGCGCT CCAGGAGAAG CTGTGTGCCA CCTACAAGCT
801 GTGCCACCCC GAGGAGCTGG TGCTGCTCGG ACACTCTCTG GGCATCCCCT
851 GGGCTCCCCT GAGCTCCTGC CCCAGCCAGG CCCTGCAGCT GGCAGGCTGC
```

TABLE 2-continued

GENE SEQUENCES

```
901 TTGAGCCAAC TCCATAGCGG CCTTTTCCTC TACCAGGGGC TCCTGCAGGC
951 CCTGGAAGGG ATATCCTAAT AA SEQ ID NO:30
```
pMON13194

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG GTGGTTCTGG CGGCGGCTCC AACATGGCTA
401 TGGCCCCTGC CCTGCAGCCC ACCCAGGGTG CCATGCCGGC CTTCGCCTCT
451 GCTTTCCAGC GCCGGGCAGG AGGGGTCCTG GTTGCTAGCC ATCTGCAGAG
501 CTTCCTGGAG GTGTCGTACC GCGTTCTACG CCACCTTGCG CAGCCCACAC
551 CATTGGGCCC TGCCAGCTCC CTGCCCCAGA GCTTCCTGCT CAAGTCTTTA
601 GAGCAAGTGA GAAAGATCCA GGGCGATGGC GCAGCGCTCC AGGAGAAGCT
651 GTGTGCCACC TACAAGCTGT GCCACCCCGA GGAGCTGGTG CTGCTCGGAC
701 ACTCTCTGGG CATCCCCTGG GCTCCCCTGA GCTCCTGCCC CAGCCAGGCC
751 CTGCAGCTGG CAGGCTGCTT GAGCCAACTC CATAGCGGCC TTTTCCTCTA
801 CCAGGGGCTC CTGCAGGCCC TGGAAGGGAT ATCCCCCGAG TTGGGTCCCA
851 CCTTGGACAC ACTGCAGCTG GACGTCGCCG ACTTTGCCAC CACCATCTGG
901 CAGCAGATGG AAGAACTGGG ATAATAA SEQ ID NO:31
```
pMON13195

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTATGGCC
451 CCTGCCCTGC AGCCCACCCA GGGTGCCATG CCGGCCTTCG CCTCTGCTTT
501 CCAGCGCCGG GCAGGAGGGG TCCTGGTTGC TAGCCATCTG CAGAGCTTCC
551 TGGAGGTGTC GTACCGCGTT CTACGCCACC TTGCGCAGCC CACACCATTG
601 GGCCCTGCCA GCTCCCTGCC CCAGAGCTTC CTGCTCAAGT CTTTAGAGCA
651 AGTGAGAAAG ATCCAGGGCG ATGGCGCAGC GCTCCAGGAG AAGCTGTGTG
701 CCACCTACAA GCTGTGCCAC CCCGAGGAGC TGGTGCTGCT CGGACACTCT
751 CTGGGCATCC CCTGGGCTCC CCTGAGCTCC TGCCCCAGCC AGGCCCTGCA
801 GCTGGCAGGC TGCTTGAGCC AACTCCATAG CGGCCTTTTC CTCTACCAGG
851 GGCTCCTGCA GGCCCTGGAA GGGATATCCC CCGAGTTGGG TCCCACCTTG
901 GACACACTGC AGCTGGACGT CGCCGACTTT GCCACCACCA TCTGGCAGCA
951 GATGGAAGAA CTGGGATAAT AA SEQ ID NO:32
```
pMON13196

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG GTGGTTCTGG CGGCGGCTCC AACATGGCTA
401 CCCAGGGTGC CATGCCGGCC TTCGCCTCTG CTTTCCAGCG CCGGGCAGGA
451 GGGGTCCTGG TTGCTAGCCA TCTGCAGAGC TTCCTGGAGG TGTCGTACCG
501 CGTTCTACGC CACCTTGCGC AGCCCACACC ATTGGGCCCT GCCAGCTCCC
551 TGCCCCAGAG CTTCCTGCTC AAGTCTTTAG AGCAAGTGAG AAAGATCCAG
601 GGCGATGGCG CAGCGCTCCA GGAGAAGCTG TGTGCCACCT ACAAGCTGTG
651 CCACCCCGAG GAGCTGGTGC TGCTCGGACA CTCTCTGGGC ATCCCCTGGG
701 CTCCCCTGAG CTCCTGCCCC AGCCAGGCCC TGCAGCTGGC AGGCTGCTTG
751 AGCCAACTCC ATAGCGGCCT TTTCCTCTAC AGGGGCTCC TGCAGGCCCT
801 GGAAGGGATA TCCCCCGAGT TGGGTCCCAC CTTGGACACA CTGCAGCTGG
851 ACGTCGCCGA CTTTGCCACC ACCATCTGGC AGCAGATGGA GAACTGGGA
901 ATGGCCCCTG CCCTGCAGCC CTAATAA SEQ ID NO:33
```
pMON13197

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTACCCAG
```

TABLE 2-continued

GENE SEQUENCES

```
451 GGTGCCATGC CGGCCTTCGC CTCTGCTTTC CAGCGCCGGG CAGGAGGGGT
501 CCTGGTTGCT AGCCATCTGC AGAGCTTCCT GGAGGTGTCG TACCGCGTTC
551 TACGCCACCT TGCGCAGCCC ACACCATTGG GCCCTGCCAG CTCCCTGCCC
601 CAGAGCTTCC TGCTCAAGTC TTTAGAGCAA GTGAGAAAGA TCCAGGGCGA
651 TGGCGCAGCG CTCCAGGAGA AGCTGTGTGC CACCTACAAG CTGTGCCACC
701 CCGAGGAGCT GGTGCTGCTC GGACACTCTC TGGGCATCCC CTGGGCTCCC
751 CTGAGCTCCT GCCCCAGCCA GGCCCTGCAG CTGGCAGGCT GCTTGAGCCA
801 ACTCCATAGC GGCCTTTTCC TCTACCAGGG GCTCCTGCAG GCCCTGGAAG
851 GGATATCCCC CGAGTTGGGT CCCACCTTGG ACACACTGCA GCTGGACGTC
901 GCCGACTTTG CCACCACCAT CTGGCAGCAG ATGGAAGAAC TGGGAATGGC
951 CCCTGCCCTG CAGCCCTAAT AA SEQ ID NO:34
```
pMON13198

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG GTGGTTCTGG CGGCGGCTCC AACATGGCTT
401 CTGCTTTCCA GCGCCGGGCA GGAGGGGTCC TGGTTGCTAG CCATCTGCAG
451 AGCTTCCTGG AGGTGTCGTA CCGCGTTCTA CGCCACCTTG CGCAGCCCAC
501 ACCATTGGGC CCTGCCAGCT CCCTGCCCCA GAGCTTCCTG CTCAAGTCTT
551 TAGAGCAAGT GAGAAAGATC CAGGGCGATG GCGCAGCGCT CCAGGAGAAG
601 CTGTGTGCCA CCTACAAGCT GTGCCACCCC GAGGAGCTGG TGCTGCTCGG
651 ACACTCTCTG GGCATCCCCT GGGCTCCCCT GAGCTCCTGC CCCAGCCAGG
701 CCCTGCAGCT GGCAGGCTGC TTGAGCCAAC TCCATAGCGG CCTTTTCCTC
751 TACCAGGGGC TCCTGCAGGC CCTGGAAGGG ATATCCCCCG AGTTGGGTCC
801 CACCTTGGAC ACACTGCAGC TGGACGTCGC CGACTTTGCC ACCACCATCT
851 GGCAGCAGAT GGAAGAACTG GGAATGGCCC CTGCCCTGCA GCCCACCCAG
901 GGTGCCATGC CGGCCTTCGC CTAATAA SEQ ID NO:35
```
pMON13199

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGACCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTTCTGCT
451 TTCCAGCGCC GGGCAGGAGG GGTCCTGGTT GCTAGCCATC TGCAGAGCTT
501 CCTGGAGGTG TCGTACCGCG TTCTACGCCA CCTTGCGCAG CCCACACCAT
551 TGGGCCCTGC CAGCTCCCTG CCCCAGAGCT TCCTGCTCAA GTCTTTAGAG
601 CAAGTGAGAA AGATCCAGGG CGATGGCGCA GCGCTCCAGG AGAAGCTGTG
651 TGCCACCTAC AAGCTGTGCC ACCCCGAGGA GCTGGTGCTG CTCGGACACT
701 CTCTGGGCAT CCCCTGGGCT CCCCTGAGCT CCTGCCCCAG CCAGGCCCTG
751 CAGCTGGCAG GCTGCTTGAG CCAACTCCAT AGCGGCCTTT TCCTCTACCA
801 GGGGCTCCTG CAGGCCCTGG AAGGGATATC CCCCGAGTTG GGTCCCACCT
851 TGGACACACT GCAGCTGGAC GTCGCCGACT TTGCCACCAC CATCTGGCAG
901 CAGATGGAAG AACTGGGAAT GGCCCCTGCC CTGCAGCCCA CCCAGGGTGC
951 CATGCCGGCC TTCGCCTAAT AA SEQ ID NO:36
```
pMON31112

```
  1 ATGGCTAACT GCTCTAACAT GATCGATGAA ATCATCACCC ACCTGAAGCA
 51 GCCACCGCTG CCGCTGCTGG ACTTCAACAA CCTCAATGGT GAAGACCAAG
101 ATATCCTAAT GGACAATAAC CTTCGTCGTC CAAACCTCGA GGCATTCAAC
151 CGTGCTGTCA AGTCTCTGCA GAATGCATCA GCAATTGAGA GCATTCTTAA
201 AAATCTCCTG CCATGTCTGC CGCTAGCCAC GGCCGCACCC ACGCGACATC
251 CAATCCATAT CAAGGACGGT GACTGGAATG AATTCCGTCG TAAACTGACC
301 TTCTATCTGA AAACCTTGGA GAACGCGCAG GCTCAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTACCCAG
451 GGTGCCATGC CGGCCTTCGC CTCTGCTTTC CAGCGCCGGG CAGGAGGGGT
501 CCTGGTTGCT AGCCATCTGC AGAGCTTCCT GGAGGTGTCG TACCGCGTTC
551 TACGCCACCT TGCGCAGCCC TCTGGCGGCT CTGGCGGCTC TCAGAGCTTC
601 CTGCTCAAGT CTTTAGAGCA AGTGAGAAAG ATCCAGGGCG ATGGCGCAGC
651 GCTCCAGGAG AAGCTGTGTG CCACCTACAA GCTGTGCCAC CCCGAGGAGC
701 TGGTGCTGCT CGGACACTCT CTGGGCATCC CCTGGGCTCC CCTGAGCTCC
751 TGCCCCAGCC AGGCCCTGCA GCTGGCAGGC TGCTTGAGCC AACTCCATAG
801 CGGCCTTTTC CTCTACCAGG GGCTCCTGCA GGCCCTGGAA GGGATATCCC
851 CCGAGTTGGG TCCCACCTTG ACACACTGCA GCTGGACGT CGCCGACTTT
901 GCCACCACCA TCTGGCAGCA GATGGAAGAA CTGGGAATGG CCCCTGCCCT
951 GCAGCCCTAA TAA SEQ ID NO:37
```

TABLE 2-continued

GENE SEQUENCES pMON31113

```
  1 ATGGCTAACT GCTCTAACAT GATCGATGAA ATCATCACCC ACCTGAAGCA
 51 GCCACCGCTG CCGCTGCTGG ACTTCAACAA CCTCAATGGT GAAGACCAAG
101 ATATCCTGAT GGAAAATAAC CTTCGTCGTC CAAACCTCGA GGCATTCAAC
151 CGTGCTGTCA AGTCTCTGCA GAATGCATCA GCAATTGAGA GCATTCTTAA
201 AAATCTCCTG CCATGTCTGC CCCTGGCCAC GGCCGCACCC ACGCGACATC
251 CAATCATCAT CCGTGACGGT GACTGGAATG AATTCCGTCG TAAACTGACC
301 TTCTATCTGA AAACCTTGGA GAACGCGCAG GCTCAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTACCCAG
451 GGTGCCATGC CGGCCTTCGC CTCTGCTTTC CAGCGCCGGG CAGGAGGGGT
501 CCTGGTTGCT AGCCATCTGC AGAGCTTCCT GGAGGTGTCG TACCGCGTTC
551 TACGCCACCT TGCGCAGCCC ACACCATTGG GCCCTGCCAG CTCCCTGCCC
601 CAGAGCTTCC TGCTCAAGTC TTTAGAGCAA GTGAGAAAGA TCCAGGGCGA
651 TGGCGCAGCG CTCCAGGAGA AGCTGTGTGC CACCTACAAG CTGTGCCACC
701 CCGAGGAGCT GGTGCTGCTC GGACACTCTC TGGGCATCCC CTGGGCTCCC
751 CTGAGCTCCT GCCCCAGCCA GGCCCTGCAG CTGGCAGGCT GCTTGAGCCA
801 ACTCCATAGC GGCCTTTTCC TCTACCAGGG GCTCCTGCAG GCCCTGGAAG
851 GGATATCCCC CGAGTTGGGT CCCACCTTGG ACACACTGCA GCTGGACGTC
901 GCCGACTTTG CCACCACCAT CTGGCAGCAG ATGGAAGAAC TGGGAATGGC
951 CCCTGCCCTG CAGCCCTAAT AA SEQ ID NO:38
``` pMON31114

```
  1 ATGGCTAACT GCTCTAACAT GATCGATGAA ATCATCACCC ACCTGAAGCA
 51 GCCACCGCTG CCGCTGCTGG ACTTCAACAA CCTCAATGGT GAAGACCAAG
101 ATATCCTGAT GGAAAATAAC CTTCGTCGTC CAAACCTCGA GGCATTCAAC
151 CGTGCTGTCA AGTCTCTGCA GAATGCATCA GCAATTGAGA GCATTCTTAA
201 AAATCTCCTG CCATGTCTGC CCCTGGCCAC GGCCGCACCC ACGCGACATC
251 CAATCATCAT CCGTGACGGT GACTGGAATG AATTCCGTCG TAAACTGACC
301 TTCTATCTGA AAACCTTGGA GAACGCGCAG GCTCAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTACCCAG
451 GGTGCCATGC CGGCCTTCGC CTCTGCTTTC CAGCGCCGGG CAGGAGGGGT
501 CCTGGTTGCT AGCCATCTGC AGAGCTTCCT GGAGGTGTCG TACCGCGTTC
551 TACGCCACCT TGCGCAGCCC TCTGGCGGCT CTGGCGGCTC TCAGAGCTTC
601 CTGCTCAAGT CTTTAGAGCA AGTGAGAAAG ATCCAGGGCG ATGGCGCAGC
651 GCTCCAGGAG AAGCTGTGTG CCACCTACAA GCTGTGCCAC CCCGAGGAGC
701 TGGTGCTGCT CGGACACTCT CTGGGCATCC CCTGGGCTCC CCTGAGCTCC
751 TGCCCCAGCC AGGCCCTGCA GCTGGCAGGC TGCTTGAGCC AACTCCATAG
801 CGGCCTTTTC CTCTACCAGG GGCTCCTGCA GGCCCTGGAA GGGATATCCC
851 CCGAGTTGGG TCCCACCTTG GACACACTGC AGCTGGACGT CGCCGACTTT
901 GCCACCACCA TCTGGCAGCA GATGGAAGAA CTGGGAATGG CCCCTGCCCT
951 GCAGCCCTAA TAA SEQ ID NO:39
``` pMON31115

```
  1 ATGGCTAACT GCTCTAACAT GATCGATGAA ATCATCACCC ACCTGAAGCA
 51 GCCACCGCTG CCGCTGCTGG ACTTCAACAA CCTCAATGGT GAAGACCAAG
101 ATATCCTAAT GGACAATAAC CTTCGTCGTC CAAACCTCGA GGCATTCAAC
151 CGTGCTGTCA AGTCTCTGCA GAATGCATCA GCAATTGAGA GCATTCTTAA
201 AAATCTCCTG CCATGTCTGC CGCTAGCCAC GGCCGCACCC ACGCGACATC
251 CAATCCATAT CAAGGACGGT GACTGGAATG AATTCCGTCG TAAACTGACC
301 TTCTATCTGA AAACCTTGGA GAACGCGCAG GCTCAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GGCTACCCAG
451 GGTGCCATGC CGGCCTTCGC CTCTGCTTTC CAGCGCCGGG CAGGAGGGGT
501 CCTGGTTGCT AGCCATCTGC AGAGCTTCCT GGAGGTGTCG TACCGCGTTC
551 TACGCCACCT TGCGCAGCCC ACACCATTGG GCCCTGCCAG CTCCCTGCCC
601 CAGAGCTTCC TGCTCAAGTC TTTAGAGCAA GTGAGAAAGA TCCAGGGCGA
651 TGGCGCAGCG CTCCAGGAGA AGCTGTGTGC CACCTACAAG CTGTGCCACC
701 CCGAGGAGCT GGTGCTGCTC GGACACTCTC TGGGCATCCC CTGGGCTCCC
751 CTGAGCTCCT GCCCCAGCCA GGCCCTGCAG CTGGCAGGCT GCTTGAGCCA
801 ACTCCATAGC GGCCTTTTCC TCTACCAGGG GCTCCTGCAG GCCCTGGAAG
851 GGATATCCCC CGAGTTGGGT CCCACCTTGG ACACACTGCA GCTGGACGTC
901 GCCGACTTTG CCACCACCAT CTGGCAGCAG ATGGAAGAAC TGGGAATGGC
951 CCCTGCCCTG CAGCCCTAAT AA SEQ ID NO:40
``` pMON28505

```
GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGAGGTTCACCCT
TTGCCTACACCTGTCCTGCTGCCTGCTGTGGACTTTAGCTTGGGAGAATGGAAAACCCAGATGGAGGAGACCAAG
GCACAGGACATTCTGGGAGCAGTGACCCTTCTGCTGGAGGGAGTGATGGCAGCACGGGACAACTGGGACCCACT
TGCCTCTCATCCCTCCTGGGGCAGCTTTCTGGACAGGTCCGTCTCCTCCTTGGGGCCCTGCAGAGCCTCCTTGGA
```

TABLE 2-continued

GENE SEQUENCES

ACCCAGCTTCCTCCACAGGGCAGGACCACAGCTCACAAGGATCCCAATGCCATCTTCCTGAGCTTCCAACACCTG
CTCCGAGGAAAGGTGCGTTTCCTGATGCTTGTAGGAGGGTCCACCCTCTGCGTCAGGGAATTCGGCGGCAACATG
GCGTCTCCCGCTCCGCCTGCTTGTGACCTCCGAGTCCTCAGTAAACTGCTTCGTGACTCCCATGTCCTTCACAGC
AGACTGAGCCAGTGCCCA SEQ ID NO:41
pMON28506

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGTTGCCTACACCT
GTCCTGCTGCCTGCTGTGGACTTTAGCTTGGGAGAATGGAAAACCCAGATGGAGGAGACCAAGGCACAGGACATT
CTGGGAGCAGTGACCCTTCTGCTGGAGGGAGTGATGGCAGCACGGGGACAACTGGGACCCACTTGCCTCTCATCC
CTCCTGGGGCAGCTTTCTGGACAGGTCCGTCTCCTCCTTGGGGCCCTGCAGAGCCTCCTTGGAACCCAGCTTCCT
CCACAGGGCAGGACCACAGCTCACAAGGATCCCAATGCCATCTTCCTGAGCTTCCAACACCTGCTCCGAGGAAAG
GTGCGTTTCCTGATGCTTGTAGGAGGGTCCACCCTCTGCGTCAGGGAATTCGGCGGCAACATGGCGTCTCCCGCT
CCGCCTGCTTGTGACCTCCGAGTCCTCAGTAAACTGCTTCGTGACTCCCATGTCCTTCACAGCAGACTGAGCCAG
TGCCCAGAGGTTCACCCT SEQ ID NO:42
pMON28507

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGTCCTGCTGCCT
GCTGTGGACTTTAGCTTGGGAGAATGGAAAACCCAGATGGAGGAGACCAAGGCACAGGACATTCTGGGAGCAGTG
ACCCTTCTGCTGGAGGGAGTGATGGCAGCACGGGGACAACTGGGACCCACTTGCCTCTCATCCCTCCTGGGGCAG
CTTTCTGGACAGGTCCGTCTCCTCCTTGGGGCCCTGCAGAGCCTCCTTGGAACCCAGCTTCCTCCACAGGGCAGG
ACCACAGCTCACAAGGATCCCAATGCCATCTTCCTGAGCTTCCAACACCTGCTCCGAGGAAAGGTGCGTTTCCTG
ATGCTTGTAGGAGGGTCCACCCTCTGCGTCAGGGAATTCGGCGGCAACATGGCGTCTCCCGCTCCGCCTGCTTGT
GACCTCCGAGTCCTCAGTAAACTGCTTCGTGACTCCCATGTCCTTCACAGCAGACTGAGCCAGTGCCCAGAGGTT
CACCCTTTGCCTACACCT SEQ ID NO:43
pMON28508

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGCTGTGGACTTT
AGCTTGGGAGAATGGAAAACCCAGATGGAGGAGACCAAGGCACAGGACATTCTGGGAGCAGTGACCCTTCTGCTG
GAGGGAGTGATGGCAGCACGGGGACAACTGGGACCCACTTGCCTCTCATCCCTCCTGGGGCAGCTTTCTGGACAG
GTCCGTCTCCTCCTTGGGGCCCTGCAGAGCCTCCTTGGAACCCAGCTTCCTCCACAGGGCAGGACCACAGCTCAC
AAGGATCCCAATGCCATCTTCCTGAGCTTCCAACACCTGCTCCGAGGAAAGGTGCGTTTCCTGATGCTTGTAGGA
GGGTCCACCCTCTGCGTCAGGGAATTCGGCGGCAACATGGCGTCTCCCGCTCCGCCTGCTTGTGACCTCCGAGTC
CTCAGTAAACTGCTTCGTGACTCCCATGTCCTTCACAGCAGACTGAGCCAGTGCCCAGAGGTTCACCCTTTGCCT
ACACCTGTCCTGCTGCCT SEQ ID NO:44
pMON28509

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGACTTTAGCTTG
GGAGAATGGAAAACCCAGATGGAGGAGACCAAGGCACAGGACATTCTGGGAGCAGTGACCCTTCTGCTGGAGGGA
GTGATGGCAGCACGGGACAACTGGGACCCACTTGCCTCTCATCCCTCCTGGGGCAGCTTTCTGGACAGGTCCGT
CTCCTCCTTGGGGCCCTGCAGAGCCTCCTTGGAACCCAGCTTCCTCCACAGGGCAGGACCACAGCTCACAAGGAT
CCCAATGCCATCTTCCTGAGCTTCCAACACCTGCTCCGAGGAAAGGTGCGTTTCCTGATGCTTGTAGGAGGGTCC
ACCCTCTGCGTCAGGGAATTCGGCGGCAACATGGCGTCTCCCGCTCCGCCTGCTTGTGACCTCCGAGTCCTCAGT
AAACTGCTTCGTGACTCCCATGTCCTTCACAGCAGACTGAGCCAGTGCCCAGAGGTTCACCCTTTGCCTACACCT
GTCCTGCTGCCTGCTGTG SEQ ID NO:45
pMON28510

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCGGTTACCCTTGAGCAAGCGCAGGAACAACAGTACGTAGAGGGCGGTGGAGGCTCCCCGGGGAACCGTCTGG
TCCAATCTCTACTATCAACCCGTCTCCTCCGTCTAAAGAATCTCATAAATCTCCAAACATGGGAGAATGGAAAAC
CAGATGGAGGAGACCAAGGCACAGGACATTCTGGAGCAGTGACCCTTCTGCTGGAGGGAGTGATGGCAGCACGGG
GACAACTGGGACCCACTTGCTCTCATCCCTCCTGGGGCAGCTTTCTGGACAGGTCCGTCTCCTCCTTGGGGCCCT
GCAGGCCTCCTTGGAACCCAGCTTCCTCCACAGGGCAGGACCACAGCTCACAAGGATCCCAATGCATCTTCCTGA
GCTTCCAACACCTGCTCCGAGGAAAGGTGCGTTTCCTGATGCTTGTAGGGGTCCACCCTCTGCGTCAGGGAATT
CGGCGGCAACATGGCGTCTCCCGCTCCGCCTGCTGTGACCTCCGAGTCCTCAGTAAACTGCTTCGTGACTCCCAT

TABLE 2-continued

| GENE SEQUENCES |
|---|

GTCCTTCACAGCAGACTGACCAGTGCCCAGAGGTTCACCCTTTGCCTACACCTGTCCTGCTGCCTGCTGTGGACT
TTAGTTG SEQ ID NO:46 pMON28511

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGGACCCACTTGC
CTCTCATCCCTCCTGGGGCAGCTTTCTGGACAGGTCCGTCTCCTCCTTGGGGCCCTGCAGAGCCTCCTTGGAACC
CAGCTTCCTCCACAGGGCAGGACCACAGCTCACAAGGATCCCAATGCCATCTTCCTGAGCTTCCAACACCTGCTC
CGAGGAAAGGTGCGTTTCCTGATGCTTGTAGGAGGGTCCACCCTCTGCGTCAGGGAATTCGGCGGCAACATGGCG
TCTCCCGCTCCGCCTGCTTGTGACCTCCGAGTCCTCAGTAAACTGCTTCGTGACTCCCATGTCCTTCACAGCAGA
CTGAGCCAGTGCCCAGAGGTTCACCCTTTGCCTACACCTGTCCTGCTGCCTGCTGTGGACTTTAGCTTGGGAGAA
TGGAAAACCCAGATGGAGGAGACCAAGGCACAGGACATTCTGGGAGCAGTGACCCTTCTGCTGGAGGGAGTGATG
GCAGCACGGGGACAACTG SEQ ID NO:47 pMON28512

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGGAACCCAGCTT
CCTCCACAGGGCAGGACCACAGCTCACAAGGATCCCAATGCCATCTTCCTGAGCTTCCAACACCTGCTCCGAGGA
AAGGTGCGTTTCCTGATGCTTGTAGGAGGGTCCACCCTCTGCGTCAGGGAATTCGGCGGCAACATGGCGTCTCCC
GCTCCGCCTGCTTGTGACCTCCGAGTCCTCAGTAAACTGCTTCGTGACTCCCATGTCCTTCACAGCAGACTGAGC
CAGTGCCCAGAGGTTCACCCTTTGCCTACACCTGTCCTGCTGCCTGCTGTGGACTTTAGCTTGGGAGAATGGAAA
ACCCAGATGGAGGAGACCAAGGCACAGGACATTCTGGGAGCAGTGACCCTTCTGCTGGAGGGAGTGATGGCAGCA
CGGGGACAACTGGGACCCACTTGCCTCTCATCCCTCCTGGGGCAGCTTTCTGGACAGGTCCGTCTCCTCCTTGGG
GCCCTGCAGAGCCTCCTT SEQ ID NO:48 pMON28513

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGGCAGGACCACA
GCTCACAAGGATCCCAATGCCATCTTCCTGAGCTTCCAACACCTGCTCCGAGGAAAGGTGCGTTTCCTGATGCTT
GTAGGAGGGTCCACCCTCTGCGTCAGGGAATTCGGCGGCAACATGGCGTCTCCCGCTCCGCCTGCTTGTGACCTC
CGAGTCCTCAGTAAACTGCTTCGTGACTCCCATGTCCTTCACAGCAGACTGAGCCAGTGCCCAGAGGTTCACCCT
TTGCCTACACCTGTCCTGCTGCCTGCTGTGGACTTTAGCTTGGGAGAATGGAAAACCCAGATGGAGGAGACCAAG
GCACAGGACATTCTGGGAGCAGTGACCCTTCTGCTGGAGGGAGTGATGGCAGCACGGGGACAACTGGGACCCACT
TGCCTCTCATCCCTCCTGGGGCAGCTTTCTGGACAGGTCCGTCTCCTCCTTGGGGCCCTGCAGAGCCTCCTTGGA
ACCCAGCTTCCTCCACAG SEQ ID NO:49 pMON28514

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGCTCACAAGGAT
CCCAATGCCATCTTCCTGAGCTTCCAACACCTGCTCCGAGGAAAGGTGCGTTTCCTGATGCTTGTAGGAGGGTCC
ACCCTCTGCGTCAGGGAATTCGGCGGCAACATGGCGTCTCCCGCTCCGCCTGCTTGTGACCTCCGAGTCCTCAGT
AAACTGCTTCGTGACTCCCATGTCCTTCACAGCAGACTGAGCCAGTGCCCAGAGGTTCACCCTTTGCCTACACCT
GTCCTGCTGCCTGCTGTGGACTTTAGCTTGGGAGAATGGAAAACCCAGATGGAGGAGACCAAGGCACAGGACATT
CTGGGAGCAGTGACCCTTCTGCTGGAGGGAGTGATGGCAGCACGGGGACAACTGGGACCCACTTGCCTCTCATCC
CTCCTGGGGCAGCTTTCTGGACAGGTCCGTCTCCTCCTTGGGGCCCTGCAGAGCCTCCTTGGAACCCAGCTTCCT
CCACAGGGCAGGACCACA SEQ ID NO:50 pMON28515

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGATCCCAATGCC
ATCTTCCTGAGCTTCCAACACCTGCTCCGAGGAAAGGTGCGTTTCCTGATGCTTGTAGGAGGGTCCACCCTCTGC
GTCAGGGAATTCGGCGGCAACATGGCGTCTCCCGCTCCGCCTGCTTGTGACCTCCGAGTCCTCAGTAAACTGCTT
CGTGACTCCCATGTCCTTCACAGCAGACTGAGCCAGTGCCCAGAGGTTCACCCTTTGCCTACACCTGTCCTGCTG
CCTGCTGTGGACTTTAGCTTGGGAGAATGGAAAACCCAGATGGAGGAGACCAAGGCACAGGACATTCTGGGAGCA
GTGACCCTTCTGCTGGAGGGAGTGATGGCAGCACGGGGACAACTGGGACCCACTTGCCTCTCATCCCTCCTGGGG
CAGCTTTCTGGACAGGTCCGTCTCCTCCTTGGGGCCCTGCAGAGCCTCCTTGGAACCCAGCTTCCTCCACAGGGC
AGGACCACAGCTCACAAG SEQ ID NO:51

TABLE 2-continued

GENE SEQUENCES pMON28516

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGCCATCTTCCTG
AGCTTCCAACACCTGCTCCGAGGAAAGGTGCGTTTCCTGATGCTTGTAGGAGGGTCCACCCTCTGCGTCAGGGAA
TTCGGCGGCAACATGGCGTCTCCCGCTCCGCCTGCTTGTGACCTCCGAGTCCTCAGTAAACTGCTTCGTGACTCC
CATGTCCTTCACAGCAGACTGAGCCAGTGCCCAGAGGTTCACCCTTTGCCTACACCTGTCCTGCTGCCTGCTGTG
GACTTTAGCTTGGGAGAATGGAAAACCCAGATGGAGGAGACCAAGGCACAGGACATTCTGGGAGCAGTGACCCTT
CTGCTGGAGGGAGTGATGGCAGCACGGGGACAACTGGGACCCACTTGCCTCTCATCCCTCCTGGGGCAGCTTTCT
GGACAGGTCCGTCTCCTCCTTGGGGCCCTGCAGAGCCTCCTTGGAACCCAGCTTCCTCCACAGGGCAGGACCACA
GCTCACAAGGATCCCAAT SEQ ID NO:52 pMON28519

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGAGGTTCACCCT
TTGCCTACACCTGTCCTGCTGCCTGCTGTGGACTTTAGCTTGGGAGAATGGAAAACCCAGATGGAGGAGACCAAG
GCACAGGACATTCTGGGAGCAGTGACCCTTCTGCTGGAGGGAGTGATGGCAGCACGGGGACAACTGGGACCCACT
TGCCTCTCATCCCTCCTGGGGCAGCTTTCTGGACAGGTCCGTCTCCTCCTTGGGGCCCTGCAGAGCCTCCTTGGA
ACCCAGCTTCCTCCACAGGGCAGGACCACAGCTCACAAGGATCCCATCTTCCTGAGCTTCCAACACCTG
CTCCGAGGAAAGGTGCGTTTCCTGATGCTTGTAGGAGGGTCCACCCTCTGCGTCAGGGAATTCGGCAACATGGCG
TCTCCCGCTCCGCCTGCTTGTGACCTCCGAGTCCTCAGTAAACTGCTTCGTGACTCCCATGTCCTTCACAGCAGA
CTGAGCCAGTGCCCA SEQ ID NO:53 pMON28520

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGTTGCCTACACCT
GTCCTGCTGCCTGCTGTGGACTTTAGCTTGGGAGAATGGAAAACCCAGATGGAGGAGACCAAGGCACAGGACATT
CTGGGAGCAGTGACCCTTCTGCTGGAGGGAGTGATGGCAGCACGGGGACAACTGGGACCCACTTGCCTCTCATCC
CTCCTGGGGCAGCTTTCTGGACAGGTCCGTCTCCTCCTTGGGGCCCTGCAGAGCCTCCTTGGAACCCAGCTTCCT
CCACAGGGCAGGACCACAGCTCACAAGGATCCCAATGCCATCTTCCTGAGCTTCCAACACCTGCTCCGAGGAAAG
GTGCGTTTCCTGATGCTTGTAGGAGGGTCCACCCTCTGCGTCAGGGAATTCGGCAACATGGCGTCTCCCGCTCCG
CCTGCTTGTGACCTCCGAGTCCTCAGTAAACTGCTTCGTGACTCCCATGTCCTTCACAGCAGACTGAGCCAGTGC
CCAGAGGTTCACCCT SEQ ID NO:54 pMON28521

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGTCCTGCTGCCT
GCTGTGGACTTTAGCTTGGGAGAATGGAAAACCCAGATGGAGGAGACCAAGGCACAGGACATTCTGGGAGCAGTG
ACCCTTCTGCTGGAGGGAGTGATGGCAGCACGGGGACAACTGGGACCCACTTGCCTCTCATCCCTCCTGGGGCAG
CTTTCTGGACAGGTCCGTCTCCTCCTTGGGGCCCTGCAGAGCCTCCTTGGAACCCAGCTTCCTCCACAGGGCAGG
ACCACAGCTCACAAGGATCCCAATGCCATCTTCCTGAGCTTCCAACACCTGCTCCGAGGAAAGGTGCGTTTCCTG
ATGCTTGTAGGAGGGTCCACCCTCTGCGTCAGGGAATTCGGCAACATGGCGTCTCCCGCTCCGCCTGCTTGTGAC
CTCCGAGTCCTCAGTAAACTGCTTCGTGACTCCCATGTCCTTCACAGCAGACTGAGCCAGTGCCCAGAGGTTCAC
CCTTTGCCTACACCT SEQ ID NO:55 pMON28522

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGCTGTGGACTTT
AGCTTGGGAGAATGGAAAACCCAGATGGAGGAGACCAAGGCACAGGACATTCTGGGAGCAGTGACCCTTCTGCTG
GAGGGAGTGATGGCAGCACGGGGACAACTGGGACCCACTTGCCTCTCATCCCTCCTGGGGCAGCTTTCTGGACAG
GTCCGTCTCCTCCTTGGGGCCCTGCAGAGCCTCCTTGGAACCCAGCTTCCTCCACAGGGCAGGACCACAGCTCAC
AAGGATCCCAATGCCATCTTCCTGAGCTTCCAACACCTGCTCCGAGGAAAGGTGCGTTTCCTGATGCTTGTAGGA
GGGTCCACCCTCTGCGTCAGGGAATTCGGCAACATGGCGTCTCCCGCTCCGCCTGCTTGTGACCTCCGAGTCCTC
AGTAAACTGCTTCGTGACTCCCATGTCCTTCACAGCAGACTGAGCCAGTGCCCAGAGGTTCACCCTTTGCCTACA
CCTGTCCTGCTGCCT SEQ ID NO:56

TABLE 2-continued

GENE SEQUENCES pMON28523

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGACTTTAGCTTG
GGAGAATGGAAAACCCAGATGGAGGAGACCAAGGCACAGGACATTCTGGGAGCAGTGACCCTTCTGCTGGAGGGA
GTGATGGCAGCACGGGGACAACTGGGACCCACTTGCCTCTCATCCCTCCTGGGGCAGCTTTCTGGACAGGTCCGT
CTCCTCCTTGGGGCCCTGCAGAGCCTCCTTGGAACCCAGCTTCCTCCACAGGGCAGGACCACAGCTCACAAGGAT
CCCAATGCCATCTTCCTGAGCTTCCAACACCTGCTCCGAGGAAAGGTGCGTTTCCTGATGCTTGTAGGAGGGTCC
ACCCTCTGCGTCAGGGAATTCGGCAACATGGCGTCTCCCGCTCCGCCTGCTTGTGACCTCCGAGTCCTCAGTAAA
CTGCTTCGTGACTCCCATGTCCTTCACAGCAGACTGAGCCAGTGCCCAGAGGTTCACCCTTTGCCTACACCTGTC
CTGCTGCCTGCTGTG SEQ ID NO:57 pMON28524

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGGAGAATGGAAA
ACCCAGATGGAGGAGACCAAGGCACAGGACATTCTGGGAGCAGTGACCCTTCTGCTGGAGGGAGTGATGGCAGCA
CGGGGACAACTGGGACCCACTTGCCTCTCATCCCTCCTGGGGCAGCTTTCTGGACAGGTCCGTCTCCTCCTTGGG
GCCCTGCAGAGCCTCCTTGGAACCCAGCTTCCTCCACAGGGCAGGACCACAGCTCACAAGGATCCCAATGCCATC
TTCCTGAGCTTCCAACACCTGCTCCGAGGAAAGGTGCGTTTCCTGATGCTTGTAGGAGGGTCCACCCTCTGCGTC
AGGGAATTCGGCAACATGGCGTCTCCCGCTCCGCCTGCTTGTGACCTCCGAGTCCTCAGTAAACTGCTTCGTGAC
TCCCATGTCCTTCACAGCAGACTGAGCCAGTGCCCAGAGGTTCACCCTTTGCCTACACCTGTCCTGCTGCCTGCT
GTGGACTTTAGCTTG SEQ ID NO:58 pMON28525

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGGACCCACTTGC
CTCTCATCCCTCCTGGGGCAGCTTTCTGGACAGGTCCGTCTCCTCCTTGGGGCCCTGCAGAGCCTCCTTGGAACC
CAGCTTCCTCCACAGGGCAGGACCACAGCTCACAAGGATCCCAATGCCATCTTCCTGAGCTTCCAACACCTGCTC
CGAGGAAAGGTGCGTTTCCTGATGCTTGTAGGAGGGTCCACCCTCTGCGTCAGGGAATTCGGCAACATGGCGTCT
CCCGCTCCGCCTGCTTGTGACCTCCGAGTCCTCAGTAAACTGCTTCGTGACTCCCATGTCCTTCACAGCAGACTG
AGCCAGTGCCCAGAGGTTCACCCTTTGCCTACACCTGTCCTGCTGCCTGCTGTGGACTTTAGCTTGGGAGAATGG
AAAACCCAGATGGAGGAGACCAAGGCACAGGACATTCTGGGAGCAGTGACCCTTCTGCTGGAGGGAGTGATGGCA
GCACGGGGACAACTG SEQ ID NO:59 pMON28526

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGGAACCCAGCTT
CCTCCACAGGGCAGGACCACAGCTCACAAGGATCCCAATGCCATCTTCCTGAGCTTCCAACACCTGCTCCGAGGA
AAGGTGCGTTTCCTGATGCTTGTAGGAGGGTCCACCCTCTGCGTCAGGGAATTCGGCAACATGGCGTCTCCCGCT
CCGCCTGCTTGTGACCTCCGAGTCCTCAGTAAACTGCTTCGTGACTCCCATGTCCTTCACAGCAGACTGAGCCAG
TGCCCAGAGGTTCACCCTTTGCCTACACCTGTCCTGCTGCCTGCTGTGGACTTTAGCTTGGGAGAATGGAAAACC
CAGATGGAGGAGACCAAGGCACAGGACATTCTGGGAGCAGTGACCCTTCTGCTGGAGGGAGTGATGGCAGCACGG
GGACAACTGGGACCCACTTGCCTCTCATCCCTCCTGGGGCAGCTTTCTGGACAGGTCCGTCTCCTCCTTGGGGCC
CTGCAGAGCCTCCTT SEQ ID NO:60 pMON28527

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGGCAGGACCACA
GCTCACAAGGATCCCAATGCCATCTTCCTGAGCTTCCAACACCTGCTCCGAGGAAAGGTGCGTTTCCTGATGCTT
GTAGGAGGGTCCACCCTCTGCGTCAGGGAATTCGGCAACATGGCGTCTCCCGCTCCGCCTGCTTGTGACCTCCGA
GTCCTCAGTAAACTGCTTCGTGACTCCCATGTCCTTCACAGCAGACTGAGCCAGTGCCCAGAGGTTCACCCTTTG
CCTACACCTGTCCTGCTGCCTGCTGTGGACTTTAGCTTGGGAGAATGGAAAACCCAGATGGAGGAGACCAAGGCA
CAGGACATTCTGGGAGCAGTGACCCTTCTGCTGGAGGGAGTGATGGCAGCACGGGGACAACTGGGACCCACTTGC
CTCTCATCCCTCCTGGGGCAGCTTTCTGGACAGGTCCGTCTCCTCCTTGGGGCCCTGCAGAGCCTCCTTGGAACC
CAGCTTCCTCCACAG SEQ ID NO:61

TABLE 2-continued

GENE SEQUENCES pMON28528

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGCTCACAAGGAT
CCCAATGCCATCTTCCTGAGCTTCCAACACCTGCTCCGAGGAAAGGTGCGTTTCCTGATGCTTGTAGGAGGGTCC
ACCCTCTGCGTCAGGGAATTCGGCAACATGGCGTCTCCCGCTCCGCCTGCTTGTGACCTCCGAGTCCTCAGTAAA
CTGCTTCGTGACTCCCATGTCCTTCACAGCAGACTGAGCCAGTGCCCAGAGGTTCACCCTTTGCCTACACCTGTC
CTGCTGCCTGCTGTGGACTTTAGCTTGGGAGAATGGAAAACCCAGATGGAGGAGACCAAGGCACAGGACATTCTG
GGAGCAGTGACCCTTCTGCTGGAGGGAGTGATGGCAGCACGGGGACAACTGGGACCCACTTGCCTCTCATCCCTC
CTGGGGCAGCTTTCTGGACAGGTCCGTCTCCTCCTTGGGGCCCTGCAGAGCCTCCTTGGAACCCAGCTTCCTCCA
CAGGGCAGGACCACA SEQ ID NO:62 pMON28529

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGATCCCAATGCC
ATCTTCCTGAGCTTCCAACACCTGCTCCGAGGAAAGGTGCGTTTCCTGATGCTTGTAGGAGGGTCCACCCTCTGC
GTCAGGGAATTCGGCAACATGGCGTCTCCCGCTCCGCCTGCTTGTGACCTCCGAGTCCTCAGTAAACTGCTTCGT
GACTCCCATGTCCTTCACAGCAGACTGAGCCAGTGCCCAGAGGTTCACCCTTTGCCTACACCTGTCCTGCTGCCT
GCTGTGGACTTTAGCTTGGGAGAATGGAAAACCCAGATGGAGGAGACCAAGGCACAGGACATTCTGGGAGCAGTG
ACCCTTCTGCTGGAGGGAGTGATGGCAGCACGGGGACAACTGGGACCCACTTGCCTCTCATCCCTCCTGGGGCAG
CTTTCTGGACAGGTCCGTCTCCTCCTTGGGGCCCTGCAGAGCCTCCTTGGAACCCAGCTTCCTCCACAGGGCAGG
ACCACAGCTCACAAG SEQ ID NO:63 pMON28530

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGCCATCTTCCTG
AGCTTCCAACACCTGCTCCGAGGAAAGGTGCGTTTCCTGATGCTTGTAGGAGGGTCCACCCTCTGCGTCAGGGAA
TTCGGCAACATGGCGTCTCCCGCTCCGCCTGCTTGTGACCTCCGAGTCCTCAGTAAACTGCTTCGTGACTCCCAT
GTCCTTCACAGCAGACTGAGCCAGTGCCCAGAGGTTCACCCTTTGCCTACACCTGTCCTGCTGCCTGCTGTGGAC
TTTAGCTTGGGAGAATGGAAAACCCAGATGGAGGAGACCAAGGCACAGGACATTCTGGGAGCAGTGACCCTTCTG
CTGGAGGGAGTGATGGCAGCACGGGGACAACTGGGACCCACTTGCCTCTCATCCCTCCTGGGGCAGCTTTCTGGA
CAGGTCCGTCTCCTCCTTGGGGCCCTGCAGAGCCTCCTTGGAACCCAGCTTCCTCCACAGGGCAGGACCACAGCT
CACAAGGATCCCAAT SEQ ID NO:64 pMON28533

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTGACTTCCAAACCTGGAGAGCTTCGTAAGGG
CTGTCAAGAACTTAGAAAATGCATCAGGTATGAGGCAATTCTTCGTAATCTCCAACCATGTCTGCCCTCTGCCAC
GGCCGCACCCTCTCGCATCCAATCATCATCAAGGCAGGTGACTGGCAAGAATTCCGGGAAAAACTGACGTTCTAT
TGGTTACCCTTGAGCAAGCGCAGGAACAACAGTACGTAGAGGGCGGTGGAGGCTCCCCGGTAACCGTCTGGTCCA
ATCTCTACTATCAACCCGTCTCCTCCGTCTAAAGAATCTCATAAATCTCCAAACATGGAGGTTCACCCTTTGCCT
ACACCTGTCCTGCTGCCTGCTGTGGACTTTAGCTTGGGAGAATGGAAAACCCAGATGGAGGAGACCAAGGCACAG
GACATTCTGGGAGCAGTGACCCTTCTGCTGGAGGGAGTGATGGCAGCACGGGGACAACTGGGACCCACTTGCCTC
TCATCCCTCCTGGGGCAGCTTTCTGGACAGGTCCGTCTCCTCCTTGGGGCCCTGCAGAGCCTCCTTGGAACCCAG
CTTCCTCCACAGGGCAGGACCACAGCTCACAAGGATCCCAATGCCATCTTCCTGAGCTTCCAACACCTGCTCCGA
GGAAAGGTGCGTTTCCTGATGCTTGTAGGAGGGTCCACCCTCTGCGTCAGGGAATTCGGCGGCAACGGCGGCAAC
ATGGCGTCCCCAGCGCCGCCTGCTTGTGACCTCCGAGTCCTCAGTAAACTGCTTCGTGACTCCCATGTCCTTCAC
AGCAGACTGAGCCAGTGCCCA SEQ ID NO:65 pMON28534

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGTTGCCTACACCT
GTCCTGCTGCCTGCTGTGGACTTTAGCTTGGGAGAATGGAAAACCCAGATGGAGGAGACCAAGGCACAGGACATT
CTGGGAGCAGTGACCCTTCTGCTGGAGGGAGTGATGGCAGCACGGGGACAACTGGGACCCACTTGCCTCTCATCC
CTCCTGGGGCAGCTTTCTGGACAGGTCCGTCTCCTCCTTGGGGCCCTGCAGAGCCTCCTTGGAACCCAGCTTCCT
CCACAGGGCAGGACCACAGCTCACAAGGATCCCAATGCCATCTTCCTGAGCTTCCAACACCTGCTCCGAGGAAAG
GTGCGTTTCCTGATGCTTGTAGGAGGGTCCACCCTCTGCGTCAGGGAATTCGGCGGCAACGGCGGCAACATGGCG
TCCCCAGCGCCGCCTGCTTGTGACCTCCGAGTCCTCAGTAAACTGCTTCGTGACTCCCATGTCCTTCACAGCAGA
CTGAGCCAGTGCCCAGAGGTTCACCCT SEQ ID NO:66

TABLE 2-continued

GENE SEQUENCES pMON28535

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGTCCTGCTGCCT
GCTGTGGACTTTAGCTTGGGAGAATGGAAAACCCAGATGGAGGAGACCAAGGCACAGGACATTCTGGGAGCAGTG
ACCCTTCTGCTGGAGGGAGTGATGGCAGCACGGGGACAACTGGGACCCACTTGCCTCTCATCCCTCCTGGGGCAG
CTTTCTGGACAGGTCCGTCTCCTCCTTGGGGCCCTGCAGAGCCTCCTTGGAACCCAGCTTCCTCCACAGGGCAGG
ACCACAGCTCACAAGGATCCCAATGCCATCTTCCTGAGCTTCCAACACCTGCTCCGAGGAAAGGTGCGTTTCCTG
ATGCTTGTAGGAGGGTCCACCCTCTGCGTCAGGGAATTCGGCGGCAACGGCGGCAACATGGCGTCCCCAGCGCCG
CCTGCTTGTGACCTCCGAGTCCTCAGTAAACTGCTTCGTGACTCCCATGTCCTTCACAGCAGACTGAGCCAGTGC
CCAGAGGTTCACCCTTTGCCTACACCT SEQ ID NO:67 pMON28536

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGCTGTGGACTTT
AGCTTGGGAGAATGGAAAACCCAGATGGAGGAGACCAAGGCACAGGACATTCTGGGAGCAGTGACCCTTCTGCTG
GAGGGAGTGATGGCAGCACGGGACAACTGGGACCCACTTGCCTCTCATCCCTCCTGGGGCAGCTTTCTGGACAG
GTCCGTCTCCTCCTTGGGGCCCTGCAGAGCCTCCTTGGAACCCAGCTTCCTCCACAGGGCAGGACCACAGCTCAC
AAGGATCCCAATGCCATCTTCCTGAGCTTCCAACACCTGCTCCGAGGAAAGGTGCGTTTCCTGATGCTTGTAGGA
GGGTCCACCCTCTGCGTCAGGGAATTCGGCGGCAACGGCGGCAACATGGCGTCCCCAGCGCCGCCTGCTTGTGAC
CTCCGAGTCCTCAGTAAACTGCTTCGTGACTCCCATGTCCTTCACAGCAGACTGAGCCAGTGCCCAGAGGTTCAC
CCTTTGCCTACACCTGTCCTGCTGCCT SEQ ID NO:68 pMON28537

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGACTTTAGCTTG
GGAGAATGGAAAACCCAGATGGAGGAGACCAAGGCACAGGACATTCTGGGAGCAGTGACCCTTCTGCTGGAGGGA
GTGATGGCAGCACGGGACAACTGGGACCCACTTGCCTCTCATCCCTCCTGGGGCAGCTTTCTGGACAGGTCCGT
CTCCTCCTTGGGGCCCTGCAGAGCCTCCTTGGAACCCAGCTTCCTCCACAGGGCAGGACCACAGCTCACAAGGAT
CCCAATGCCATCTTCCTGAGCTTCCAACACCTGCTCCGAGGAAAGGTGCGTTTCCTGATGCTTGTAGGAGGGTCC
ACCCTCTGCGTCAGGGAATTCGGCGGCAACGGCGGCAACATGGCGTCCCCAGCGCCGCCTGCTTGTGACCTCCGA
GTCCTCAGTAAACTGCTTCGTGACTCCCATGTCCTTCACAGCAGACTGAGCCAGTGCCCAGAGGTTCACCCTTTG
CCTACACCTGTCCTGCTGCCTGCTGTG SEQ ID NO:69 pMON28538

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGGAGAATGGAAA
ACCCAGATGGAGGAGACCAAGGCACAGGACATTCTGGGAGCAGTGACCCTTCTGCTGGAGGGAGTGATGGCAGCA
CGGGGACAACTGGGACCCACTTGCCTCTCATCCCTCCTGGGGCAGCTTTCTGGACAGGTCCGTCTCCTCCTTGGG
GCCCTGCAGAGCCTCCTTGGAACCCAGCTTCCTCCACAGGGCAGGACCACAGCTCACAAGGATCCCAATGCCATC
TTCCTGAGCTTCCAACACCTGCTCCGAGGAAAGGTGCGTTTCCTGATGCTTGTAGGAGGGTCCACCCTCTGCGTC
AGGGAATTCGGCGGCAACGGCGGCAACATGGCGTCCCCAGCGCCGCCTGCTTGTGACCTCCGAGTCCTCAGTAAA
CTGCTTCGTGACTCCCATGTCCTTCACAGCAGACTGAGCCAGTGCCCAGAGGTTCACCCTTTGCCTACACCTGTC
CTGCTGCCTGCTGTGGACTTTAGCTTG SEQ ID NO:70 pMON28539

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGGACCCACTTGC
CTCTCATCCCTCCTGGGGCAGCTTTCTGGACAGGTCCGTCTCCTCCTTGGGGCCCTGCAGAGCCTCCTTGGAACC
CAGCTTCCTCCACAGGGCAGGACCACAGCTCACAAGGATCCCAATGCCATCTTCCTGAGCTTCCAACACCTGCTC
CGAGGAAAGGTGCGTTTCCTGATGCTTGTAGGAGGGTCCACCCTCTGCGTCAGGGAATTCGGCGGCAACGGCGGC
AACATGGCGTCCCCAGCGCCGCCTGCTTGTGACCTCCGAGTCCTCAGTAAACTGCTTCGTGACTCCCATGTCCTT
CACAGCAGACTGAGCCAGTGCCCAGAGGTTCACCCTTTGCCTACACCTGTCCTGCTGCCTGCTGTGGACTTTAGC
TTGGGAGAATGGAAAACCCAGATGGAGGAGACCAAGGCACAGGACATTCTGGGAGCAGTGACCCTTCTGCTGGAG
GGAGTGATGGCAGCACGGGGACAACTG SEQ ID NO:71

TABLE 2-continued

GENE SEQUENCES pMON28540

```
GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGGAACCCAGCTT
CCTCCACAGGGCAGGACCACAGCTCACAAGGATCCCAATGCCATCTTCCTGAGCTTCCAACACCTGCTCCGAGGA
AAGGTGCGTTTCCTGATGCTTGTAGGAGGGTCCACCCTCTGCGTCAGGGAATTCGGCGGCAACGGCGGCAACATG
GCGTCCCCAGCGCCGCCTGCTTGTGACCTCCGAGTCCTCAGTAAACTGCTTCGTGACTCCCATGTCCTTCACAGC
AGACTGAGCCAGTGCCCAGAGGTTCACCCTTTGCCTACACCTGTCCTGCTGCCTGCTGTGGACTTTAGCTTGGGA
GAATGGAAAACCCAGATGGAGGAGACCAAGGCACAGGACATTCTGGGAGCAGTGACCCTTCTGCTGGAGGGAGTG
ATGGCAGCACGGGGACAACTGGGACCCACTTGCCTCTCATCCCTCCTGGGGCAGCTTTCTGGACAGGTCCGTCTC
CTCCTTGGGGCCCTGCAGAGCCTCCTT SEQ ID NO:72
``` pMON28541

```
GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGGCAGGACCACA
GCTCACAAGGATCCCAATGCCATCTTCCTGAGCTTCCAACACCTGCTCCGAGGAAAGGTGCGTTTCCTGATGCTT
GTAGGAGGGTCCACCCTCTGCGTCAGGGAATTCGGCGGCAACGGCGGCAACATGGCGTCCCCAGCGCCGCCTGCT
TGTGACCTCCGAGTCCTCAGTAAACTGCTTCGTGACTCCCATGTCCTTCACAGCAGACTGAGCCAGTGCCCAGAG
GTTCACCCTTTGCCTACACCTGTCCTGCTGCCTGCTGTGGACTTTAGCTTGGGAGAATGGAAAACCCAGATGGAG
GAGACCAAGGCACAGGACATTCTGGGAGCAGTGACCCTTCTGCTGGAGGGAGTGATGGCAGCACGGGGACAACTG
GGACCCACTTGCCTCTCATCCCTCCTGGGGCAGCTTTCTGGACAGGTCCGTCTCCTCCTTGGGGCCCTGCAGAGC
CTCCTTGGAACCCAGCTTCCTCCACAG SEQ ID NO:73
``` pMON28542

```
GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGCTCACAAGGAT
CCCAATGCCATCTTCCTGAGCTTCCAACACCTGCTCCGAGGAAAGGTGCGTTTCCTGATGCTTGTAGGAGGGTCC
ACCCTCTGCGTCAGGGAATTCGGCGGCAACGGCGGCAACATGGCGTCCCCAGCGCCGCCTGCTTGTGACCTCCGA
GTCCTCAGTAAACTGCTTCGTGACTCCCATGTCCTTCACAGCAGACTGAGCCAGTGCCCAGAGGTTCACCCTTTG
CCTACACCTGTCCTGCTGCCTGCTGTGGACTTTAGCTTGGGAGAATGGAAAACCCAGATGGAGGAGACCAAGGCA
CAGGACATTCTGGGAGCAGTGACCCTTCTGCTGGAGGGAGTGATGGCAGCACGGGGACAACTGGGACCCACTTGC
CTCTCATCCCTCCTGGGGCAGCTTTCTGGACAGGTCCGTCTCCTCCTTGGGGCCCTGCAGAGCCTCCTTGGAACC
CAGCTTCCTCCACAGGGCAGGACCACA SEQ ID NO:74
``` pMON28543

```
GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGATCCCAATGCC
ATCTTCCTGAGCTTCCAACACCTGCTCCGAGGAAAGGTGCGTTTCCTGATGCTTGTAGGAGGGTCCACCCTCTGC
GTCAGGGAATTCGGCGGCAACGGCGGCAACATGGCGTCCCCAGCGCCGCCTGCTTGTGACCTCCGAGTCCTCAGT
AAACTGCTTCGTGACTCCCATGTCCTTCACAGCAGACTGAGCCAGTGCCCAGAGGTTCACCCTTTGCCTACACCT
GTCCTGCTGCCTGCTGTGGACTTTAGCTTGGGAGAATGGAAAACCCAGATGGAGGAGACCAAGGCACAGGACATT
CTGGGAGCAGTGACCCTTCTGCTGGAGGGAGTGATGGCAGCACGGGGACAACTGGGACCCACTTGCCTCTCATCC
CTCCTGGGGCAGCTTTCTGGACAGGTCCGTCTCCTCCTTGGGGCCCTGCAGAGCCTCCTTGGAACCCAGCTTCCT
CCACAGGGCAGGACCACAGCTCACAAG SEQ ID NO:75
``` pMON28544

```
GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGCCATCTTCCTG
AGCTTCCAACACCTGCTCCGAGGAAAGGTGCGTTTCCTGATGCTTGTAGGAGGGTCCACCCTCTGCGTCAGGGAA
TTCGGCGGCAACGGCGGCAACATGGCGTCCCCAGCGCCGCCTGCTTGTGACCTCCGAGTCCTCAGTAAACTGCTT
CGTGACTCCCATGTCCTTCACAGCAGACTGAGCCAGTGCCCAGAGGTTCACCCTTTGCCTACACCTGTCCTGCTG
CCTGCTGTGGACTTTAGCTTGGGAGAATGGAAAACCCAGATGGAGGAGACCAAGGCACAGGACATTCTGGGAGCA
GTGACCCTTCTGCTGGAGGGAGTGATGGCAGCACGGGGACAACTGGGACCCACTTGCCTCTCATCCCTCCTGGGG
CAGCTTTCTGGACAGGTCCGTCTCCTCCTTGGGGCCCTGCAGAGCCTCCTTGGAACCCAGCTTCCTCCACAGGGC
AGGACCACAGCTCACAAGGATCCCAAT SEQ ID NO:76
```

TABLE 2-continued

GENE SEQUENCES pMON28545

GCTAACTGCTCTATAATGATCGATGAAATTATACATCACTTAAAGAGACCACCTGCACCTTTGCTGGACCCGAAC
AACCTCAATGACGAAGACGTCTCTATCCTGATGGACCGAAACCTTCGACTTCCAAACCTGGAGAGCTTCGTAAGG
GCTGTCAAGAACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAACTGACGTTC
TATCTGGTTACCCTTGAGCAAGCGCAGGAACAACAGTACGTAGAGGGCGGTGGAGGCTCCCCGGGTGAACCGTCT
GGTCCAATCTCTACTATCAACCCGTCTCCTCCGTCTAAAGAATCTCATAAATCTCCAAACATGGATCCCAATGCC
ATCTTCCTGAGCTTCCAACACCTGCTCCGAGGAAAGGTGCGTTTCCTGATGCTTGTAGGAGGGTCCACCCTCTGC
GTCAGGGAATTCGGCGGCAACATGGCGTCTCCCGCTCCGCCTGCTTGTGACCTCCGAGTCCTCAGTAAACTGCTT
CGTGACTCCCATGTCCTTCACAGCAGACTGAGCCAGTGCCCAGAGGTTCACCCTTTGCCTACACCTGTCCTGCTG
CCTGCTGTGGACTTTAGCTTGGGAGAATGGAAAACCCAGATGGAGGAGACCAAGGCACAGGACATTCTGGGAGCA
GTGACCCTTCTGCTGGAGGGAGTGATGGCAGCACGGGGACAACTGGGACCCACTTGCCTCTCATCCCTCCTGGGG
CAGCTTTCTGGACAGGTCCGTCTCCTCCTTGGGGCCCTGCAGAGCCTCCTTGGAACCCAGGGCAGGACCACAGCT
CACAAG SEQ ID NO:77
pMON15981

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGATCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GTCTTACAAG
451 CTGTGCCACC CGAGGAGCT GGTGCTGCTC GGACACTCTC TGGGCATCCC
501 CTGGGCTCCC CTGAGCTCCT GCCCCAGCCA GGCCCTGCAG CTGGCAGGCT
551 GCTTGAGCCA ACTCCATAGC GGCCTTTTCC TCTACCAGGG GCTCCTGCAG
601 GCCCTGGAAG GGATATCCCC CGAGTTGGGT CCCACCTTGG ACACACTGCA
651 GCTGGACGTC GCCGACTTTG CCACCACCAT CTGGCAGCAG ATGGAAGAAC
701 TGGGAATGGC CCCTGCCCTG CAGCCCACCC AGGGTGCCAT GCCGGCCTTC
751 GCCTCTGCTT TCCAGCGCCG GGCAGGAGGG GTCCTGGTTG CTAGCCATCT
801 GCAGAGCTTC CTGGAGGTGT CGTACCGCGT TCTACGCCAC CTTGCGCAGC
851 CCGGCGGCGG CTCTGACATG GCTACACCAT TAGGCCCTGC CAGCTCCCTG
901 CCCCAGAGCT TCCTGCTCAA GTCTTTAGAG CAAGTGAGGA AGATCCAGGG
951 CGATGGCGCA GCGCTCCAGG AGAAGCTGTG TGCCACCTAA TAA;
     SEQ ID NO:78
``` pMON15982

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGATCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GTCTCCCGAG
451 TTGGGTCCCA CCTTGGACAC ACTGCAGCTG GACGTCGCCG ACTTTGCCAC
501 CACCATCTGG CAGCAGATGG AAGAACTGGG AATGGCCCCT GCCCTGCAGC
551 CCACCCAGGG TGCCATGCCG GCCTTCGCCT CTGCTTTCCA GCGCCGGGCA
601 GGAGGGGTCC TGGTTGCTAG CCATCTGCAG AGCTTCCTGG AGGTGTCGTA
651 CCGCGTTCTA CGCCACCTTG CGCAGCCCGG CGGCGGCTCT GACATGGCTA
701 CACCATTAGG CCCTGCCAGC TCCCTGCCCC AGAGCTTCCT GCTCAAGTCT
751 TTAGAGCAAG TGAGGAAGAT CCAGGGCGAT GGCGCAGCGC TCCAGGAGAA
801 GCTGTGTGCC ACCTACAAGC TGTGCCACCC CGAGGAGCTG GTGCTGCTCG
851 GACACTCTCT GGGCATCCCC TGGGCTCCCC TGAGCTCCTG CCCCAGCCAG
901 GCCCTGCAGC TGGCAGGCTG CTTGAGCCAA CTCCATAGCG GCCTTTTCCT
951 CTACCAGGGG CTCCTGCAGG CCCTGGAAGG GATATCCTAA TAA;
     SEQ ID NO:79
``` pMON15965

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGATCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GTCTTCTGCT
451 TTCCAGCGCC GGGCAGGAGG GGTCCTGGTT GCTAGCCATC TGCAGAGCTT
501 CCTGGAGGTG TCGTACCGCG TTCTACGCCA CCTTGCGCAG CCCGGCGGCG
551 GCTCTGACAT GGCTACACCA TTAGGCCCTG CCAGCTCCCT GCCCCAGAGC
601 TTCCTGCTCA AGTCTTTAGA GCAAGTGAGG AAGATCCAGG GCGATGGCGC
651 AGCGCTCCAG GAGAAGCTGT GTGCCACCTA CAAGCTGTGC CACCCCGAGG
```

TABLE 2-continued

GENE SEQUENCES

```
701 AGCTGGTGCT GCTCGGACAC TCTCTGGGCA TCCCCTGGGC TCCCCTGAGC
751 TCCTGCCCCA GCCAGGCCCT GCAGCTGGCA GGCTGCTTGA GCCAACTCCA
801 TAGCGGCCTT TTCCTCTACC AGGGGCTCCT GCAGGCCCTG GAAGGGATAT
851 CCCCCGAGTT GGGTCCCACC TTGGACACAC TGCAGCTGGA CGTCGCCGAC
901 TTTGCCACCA CCATCTGGCA GCAGATGGAA GAACTGGGAA TGGCCCCTGC
951 CCTGCAGCCC ACCCAGGGTG CCATGCCGGC CTTCGCCTAA TAA
    SEQ ID NO:80
```
pMON15966

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGATCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GTCTATGGCC
451 CCTGCCCTGC AGCCCACCCA GGGTGCCATG CCGGCCTTCG CCTCTGCTTT
501 CCAGCGCCGG GCAGGAGGGG TCCTGGTTGC TAGCCATCTG CAGAGCTTCC
551 TGGAGGTGTC GTACCGCGTT CTACGCCACC TTGCGCAGCC CGGCGGCGGC
601 TCTGACATGG CTACACCATT AGGCCCTGCC AGCTCCCTGC CCCAGAGCTT
651 CCTGCTCAAG TCTTTAGAGC AAGTGAGGAA GATCCAGGGC GATGGCGCAG
701 CGCTCCAGGA GAAGCTGTGT GCCACCTACA AGCTGTGCCA CCCCGAGGAG
751 CTGGTGCTGC TCGGACACTC TCTGGGCATC CCTGGGCTC CCCTGAGCTC
801 CTGCCCCAGC CAGGCCCTGC AGCTGGCAGG CTGCTTGAGC CAACTCCATA
851 GCGGCCTTTT CCTCTACCAG GGGCTCCTGC AGGCCCTGGA AGGGATATCC
901 CCCGAGTTGG GTCCCACCTT GGACACACTG CAGCTGGACG TCGCCGACTT
951 TGCCACCACC ATCTGGCAGC AGATGGAAGA ACTGGGATAA TAA
    SEQ ID NO:81
```
pMON15967

```
  1 ATGGCTAACT GCTCTATAAT GATCGATGAA ATTATACATC ACTTAAAGAG
 51 ACCACCTGCA CCTTTGCTGG ACCCGAACAA CCTCAATGAC GAAGACGTCT
101 CTATCCTGAT GGATCGAAAC CTTCGACTTC CAAACCTGGA GAGCTTCGTA
151 AGGGCTGTCA AGAACTTAGA AAATGCATCA GGTATTGAGG CAATTCTTCG
201 TAATCTCCAA CCATGTCTGC CCTCTGCCAC GGCCGCACCC TCTCGACATC
251 CAATCATCAT CAAGGCAGGT GACTGGCAAG AATTCCGGGA AAAACTGACG
301 TTCTATCTGG TTACCCTTGA GCAAGCGCAG GAACAACAGT ACGTAGAGGG
351 CGGTGGAGGC TCCCCGGGTG AACCGTCTGG TCCAATCTCT ACTATCAACC
401 CGTCTCCTCC GTCTAAAGAA TCTCATAAAT CTCCAAACAT GTCTACCCAG
451 GGTGCCATGC CGGCCTTCGC CTCTGCTTTC AGCGCCGGG CAGGAGGGGT
501 CCTGGTTGCT AGCCATCTGC AGAGCTTCCT GGAGGTGTCG TACCGCGTTC
551 TACGCCACCT TGCGCAGCCC GGCGGCGGCT CTGACATGGC TACACCATTA
601 GGCCCTGCCA GCTCCCTGCC CCAGAGCTTC CTGCTCAAGT CTTTAGAGCA
651 AGTGAGGAAG ATCCAGGGCG ATGGCGCAGC GCTCCAGGAG AAGCTGTGTG
701 CCACCTACAA GCTGTGCCAC CCCGAGGAGC TGGTGCTGCT CGGACACTCT
751 CTGGGCATCC CCTGGGCTCC CCTGAGCTCC TGCCCCAGCC AGGCCCTGCA
801 GCTGGCAGGC TGCTTGAGCC AACTCCATAG CGGCCTTTTC CTCTACCAGG
851 GGCTCCTGCA GGCCCTGGAA GGGATATCCC CCGAGTTGGG TCCCACCTTG
901 GACACACTGC AGCTGGACGT CGCCGACTTT GCCACCACCA TCTGGCAGCA
951 GATGGAAGAA CTGGGAATGG CCCCTGCCCT GCAGCCCTAA TAA
    SEQ ID NO:82
```
pMON15960

```
  1 ATGGCTACAC CATTGGGCCC TGCCAGCTCC CTGCCCCAGA GCTTCCTGCT
 51 CAAGTCTTTA GAGCAAGTGA GGAAGATCCA GGGCGATGGC GCAGCGCTCC
101 AGGAGAAGCT GTGTGCCACC TACAAGCTGT GCCACCCCGA GGAGCTGGTG
151 CTGCTCGGAC ACTCTCTGGG CATCCCCTGG CTCCCCTGA GCTCCTGCCC
201 CAGCCAGGCC CTGCAGCTGG CAGGCTGCTT GAGCCAACTC CATAGCGGCC
251 TTTTCCTCTA CCAGGGGCTC CTGCAGGCCC TGGAAGGGAT ATCCCCCGAG
301 TTGGGTCCCA CCTTGGACAC ACTGCAGCTG GACGTCGCCG ACTTTGCCAC
351 CACCATCTGG CAGCAGATGG AAGAACTGGG AATGGCCCCT GCCCTGCAGC
401 CCACCCAGGG TGCCATGCCG GCCTTCGCCT CTGCTTTCCA GCGCCGGGCA
451 GGAGGGGTCC TGGTTGCTAG CCATCTGCAG AGCTTCCTGG AGGTGTCGTA
501 CCGCGTTCTA CGCCACCTTG CGCAGCCCGG CGGCGGCTCT GACATGGCTA
551 CACCATTGGG CCCTGCCAGC TCCCTGCCCC AGAGCTTCCT GCTCAAGTCT
601 TTAGAGCAAG TGAGGAAGAT CCAGGGCGAT GGCGCAGCGC TCCAGGAGAA
651 GCTGTGTGCC ACCTACAAGC TGTGCCACCC CGAGGAGCTG GTGCTGCTCG
701 GACACTCTCT GGGCATCCCC TGGGCTCCCC TGAGCTCCTG CCCCAGCCAG
751 GCCCTGCAGC TGGCAGGCTG CTTGAGCCAA CTCCATAGCG GCCTTTTCCT
801 CTACCAGGGG CTCCTGCAGG CCCTGGAAGG GATATCCCCC GAGTTGGGTC
851 CCACCTTGGA CACACTGCAG CTGGACGTCG CCGACTTTGC CACCACCATC
901 TGGCAGCAGA TGGAAGAACT GGGAATGGCC CCTGCCCTGC AGCCCACCCA
951 GGGTGCCATG CCGGCCTTCG CCTCTGCTTT CCAGCGCCGG GCAGGAGGGG
1001 TCCTGGTTGC TAGCCATCTG CAGAGCTTCC TGGAGGTGTC GTACCGCGTT
1051 CTACGCCACC TTGCGCAGCC CTGATAA SEQ ID NO:83
```

TABLE 2-continued

GENE SEQUENCES

PMON32132

TCTCCCGCTCCGCCTGCTTGTGACCTCCGAGTCCTCAGTAAACTGCTTCGTGACTCCCATGTCCTTCACAGCAGA
CTGAGCCAGTGCCCAGAGGTTCACCCTTTGCCTACACCTGTCCTGCTGCCTGCTGTGGACTTTAGCTTGGGAGAA
TGGAAAACCCAGATGGAGGAGACCAAGGCACAGGACATTCTGGGAGCAGTGACCCTTCTGCTGGAGGGAGTGATG
GCAGCACGGGGACAACTGGGACCCACTTGCCTCTCATCCCTCCTGGGGCAGCTTTCTGGACAGGTCCGTCTCCTC
CTTGGGGCCCTGCAGAGCCTCCTTGGAACCCAGCTTCCTCCACAGGGCAGGACCACAGCTCACAAGGATCCCAAT
GCCATCTTCCTGAGCTTCCAACACCTGCTCCGAGGAAAGGTGCGTTTCCTGATGCTTGTAGGAGGGTCCACCCTC
TGCGTCAGG SEQ ID NO:84

PMON32133

TCTCCCGCTCCGCCTGCTTGTGACCTCCGAGTCCTCAGTAAACTGCTTCGTGACTCCCATGTCCTTCACAGCAGA
CTGAGCCAGTGCCCAGAGGTTCACCCTTTGCCTACACCTGTCCTGCTGCCTGCTGTGGACTTTAGCTTGGGAGAA
TGGAAAACCCAGATGGAGGAGACCAAGGCACAGGACATTCTGGGAGCAGTGACCCTTCTGCTGGAGGGAGTGATG
GCAGCACGGGGACAACTGGGACCCACTTGCCTCTCATCCCTCCTGGGGCAGCTTTCTGGACAGGTCCGTCTCCTC
CTTGGGGCCCTGCAGAGCCTCCTTGGAACCCAGGGCAGGACCACAGCTCACAAGGATCCCAATGCCATCTTCCTG
AGCTTCCAACACCTGCTCCGAGGAAAGGTGCGTTTCCTGATGCTTGTAGGAGGGTCCACCCTCTGCGTCAGG
SEQ ID NO:85 pMON32134

TCCCCAGCGCCGCCTGCTTGTGACCTCCGAGTCCTCAGTAAACTGCTTCGTGACTCCCATGTCCTTCACAGCAGA
CTGAGCCAGTGCCCAGAGGTTCACCCTTTGCCTACACCTGTCCTGCTGCCTGCTGTGGACTTTAGCTTGGGAGAA
TGGAAAACCCAGATGGAGGAGACCAAGGCACAGGACATTCTGGGAGCAGTGACCCTTCTGCTGGAGGGAGTGATG
GCAGCACGGGGACAACTGGGACCCACTTGCCTCTCATCCCTCCTGGGGCAGCTTTCTGGACAGGTCCGTCTCCTC
CTTGGGGCCCTGCAGAGCCTCCTTGGAACCCAGCTTCCTCCACAGGGCAGGACCACAGCTCACAAGGATCCCAAT
GCCATCTTCCTGAGCTTCCAACACCTGCTCCGAGGAAAGGTGCGTTTCCTGATGCTTGTAGGAGGGTCCACCCTC
TGCGTCAGG SEQ ID NO:86

Pmon13181

```
  1 CCATGGCTAA CTGCTCTATA ATGATCGATG AAATTATACA CACTTAAAG
 51 AGACCACCTG CACCTTTGCT GGACCCGAAC AACCTCAATG ACGAAGACGT
101 CTCTATCCTG ATGGATCGAA ACCTTCGACT TCCAAACCTG GAGAGCTTCG
151 TAAGGGCTGT CAAGAACTTA GAAAATGCAT CAGGTATTGA GGCAATTCTT
201 CGTAATCTCC AACCATGTCT GCCCTCTGCC ACGGCCGCAC CCTCTCGACA
251 TCCAATCATC ATCAAGGCAG GTGACTGGCA AGAATTCCGG GAAAAACTGA
301 CGTTCTATCT GGTTACCCTT GAGCAAGCGC AGGAACAACA GTACGTAgag
351 ggcggtggag gctcCCCGGG TGAACCGTCT GGTCCAATCT CTACTATCAA
401 CCCGTCTCCT CCGTCTAAAG AATCTCATAA ATCTCCAAAC ATGTAAGGTA
451 CCGCATGCAA GCTT SEQ ID NO:87
```

Pmon13180.Seq

```
  1 CCATGGCTAA CTGCTCTATA ATGATCGATG AAATTATACA TCACTTAAAG
 51 AGACCACCTG CACCTTTGCT GGACCCGAAC AACCTCAATG ACGAAGACGT
101 CTCTATCCTG ATGGATCGAA ACCTTCGACT TCCAAACCTG GAGAGCTTCG
151 TAAGGGCTGT CAAGAACTTA GAAAATGCAT CAGGTATTGA GGCAATTCTT
201 CGTAATCTCC AACCATGTCT GCCCTCTGCC ACGGCCGCAC CCTCTCGACA
251 TCCAATCATC ATCAAGGCAG GTGACTGGCA AGAATTCCGG GAAAAACTGA
301 CGTTCTATCT GGTTACCCTT GAGCAAGCGC AGGAACAACA GTACGTAgag
351 ggcggtggag gctcCCCGGG TGGTGGTTCT GGCGGCGGCT CCAACATGTA
401 AGGTACCGCA TGCAAGCTT SEQ ID NO:88
``` pMON30237.seq

GCCACCCAGGACTGCTCCTTCCAACACAGCCCCATCTCCTCCGACTTCGC
TGTCAAAATCCGTGAGCTGTCTGACTACCTGCTTCAAGATTACCCAGTCA
CCGTGGCCTCCAACCTGCAGGACGAGGAGCTCTGCGGGGCGCTCTGGCGG
CTGGTCCTGGCACAGCGCTGGATGGAGCGGCTCAAGACTGTCGCTGGGTC
CAAGATGCAAGGCTTGCTGGAGCGCGTGAACACGGAGATACACTTTGTCA
CCAAATGTGCCTTTCAGCCCCCCCCCAGCTGTCTTCGCTTCGTCCAGACC
AACATCTCCCGCCTCCTGCAGGAGACCTCCGAGCAGCTGGTGGCGCTGAA
GCCCTGGATCACTCGCCAGAACTTCTCCCGGTGCCTGGAGCTGCAGTGTC
AGCCC SEQ ID NO:89 pMON30238.seq

GCCACCCAGGACTGCTCCTTCCAACACAGCCCCATCTCCTCCGACTTCGC
TGTCAAAATCCGTGAGCTGTCTGACTACCTGCTTCAAGATTACCCAGTCA
CCGTGGCCTCCAACCTGCAGGACGAGGAGCTCTGCGGGGCCTCTGGCGG
CTGGTCCTGGCACAGCGCTGGATGGAGCGGCTCAAGACTGTCGCTGGGTC
CAAGATGCAAGGCTTGCTGGAGCGCGTGAACACGGAGATACACTTTGTCA
CCAAATGTGCCTTTCAGCCCCCCCCCAGCTGTCTTCGCTTCGTCCAGACC
AACATCTCCCGCCTCCTGCAGGAGACCTCCGAGCAGCTGGTGGCGCTGAA
GCCCTGGATCACTCGCCAGAACTTCTCCCGGTGCCTGGAGCTGCAGTGTC
AGCCCGACTCCTCAACCCTG SEQ ID NO:90 pMON30239.seq

GCCACCCAGGACTGCTCCTTCCAACACAGCCCCATCTCCTCCGACTTCGC
TGTCAAAATCCGTGAGCTGTCTGACTACCTGCTTCAAGATTACCCAGTCA
CCGTGGCCTCCAACCTGCAGGACGAGGAGCTCTGCGGGGCCTCTGGCGG

TABLE 2-continued

GENE SEQUENCES

CTGGTCCTGGCACAGCGCTGGATGGAGCGGCTCAAGACTGTCGCTGGGTC
CAAGATGCAAGGCTTGCTGGAGCGCGTGAACACGGAGATACACTTTGTCA
CCAAATGTGCCTTTCAGGAGACCTCCGAGCAGCTGGTGGCGCTGAA
GCCCTGGATCACTCGCCAGAACTTCTCCCGGTGCCTGGAGCTGCAGTGTC
AGCCCGACTCCTCAACCCTG SEQ ID NO:91
pMON32329.seq GGAACTCAGGATTGTTCTTTCCAACACAGCCCCATCTCCTCCGACTTCGC
TGTCAAAATCCGTGAGCTGTCTGACTACCTGCTTCAAGATTACCCAGTCA
CCGTGGCCTCCAACCTGCAGGACGAGGAGCTCTGCGGGGGCCTCTGGCGG
CTGGTCCTGGCACAGCGCTGGATGGAGCGGCTCAAGACTGTCGCTGGGTC
CAAGATGCAAGGCTTGCTGGAGCGCGTGAACACGGAGATACACTTTGTCA
CCAAATGTGCCTTTCAGCCCCCCCCCAGCTGTCTTCGCTTCGTCCAGACC
AACATCTCCCGCCTCCTGCAGGAGACCTCCGAGCAGCTGGTGGCGCTGAA
GCCCTGGATCACTCGCCAGAACTTCTCCCGGTGCCTGGAGCTGCAGTGTC
AGCCC SEQ ID NO:92
pMON32330.seq GGTACCCAGGATTGTTCTTTCCAACACAGCCCCATCTCCTCCGACTTCGC
TGTCAAAATCCGTGAGCTGTCTGACTACCTGCTTCAAGATTACCCAGTCA
CCGTGGCCTCCAACCTGCAGGACGAGGAGCTCTGCGGGGGCCTCTGGCGG
CTGGTCCTGGCACAGCGCTGGATGGAGCGGCTCAAGACTGTCGCTGGGTC
CAAGATGCAAGGCTTGCTGGAGCGCGTGAACACGGAGATACACTTTGTCA
CCAAATGTGCCTTTCAGCCCCCCCCCAGCTGTCTTCGCTTCGTCCAGACC
AACATCTCCCGCCTCCTGCAGGAGACCTCCGAGCAGCTGGTGGCGCTGAA
GCCCTGGATCACTCGCCAGAACTTCTCCCGGTGCCTGGAGCTGCAGTGTC
AGCCCGACTCCTCAACCCTG SEQ ID NO:93
pMON32341.seq GCCACTCAGGACTGTTCTTTCCAACACAGCCCCATCTCCTCCGACTTCGC
TGTCAAAATCCGTGAGCTGTCTGACTACCTGCTTCAAGATTACCCAGTCA
CCGTGGCCTCCAACCTGCAGGACGAGGAGCTCTGCGGGGGCCTCTGGCGG
CTGGTCCTGGCACAGCGCTGGATGGAGCGGCTCAAGACTGTCGCTGGGTC
CAAGATGCAAGGCTTGCTGGAGCGCGTGAACACGGAGATACACTTTGTCA
CCAAATGTGCCTTTCAGCCCCCCCCCAGCTGTCTTCGCTTCGTCCAGACC
AACATCTCCCGCCTCCTGCAGGAGACCTCCGAGCAGCTGGTGGCGCTGAA
GCCCTGGATCACTCGCCAGAACTTCTCCCGGTGCCTGGAGCTGCAGTGTC
AGCCC SEQ ID NO:94
pMON32342.seq GCCACTCAGGACTGCTCTTTTCAACACAGCCCCATCTCCTCCGACTTCGC
TGTCAAAATCCGTGAGCTGTCTGACTACCTGCTTCAAGATTACCCAGTCA
CCGTGGCCTCCAACCTGCAGGACGAGGAGCTCTGCGGGGGCCTCTGGCGG
CTGGTCCTGGCACAGCGCTGGATGGAGCGGCTCAAGACTGTCGCTGGGTC
CAAGATGCAAGGCTTGCTGGAGCGCGTGAACACGGAGATACACTTTGTCA
CCAAATGTGCCTTTCAGCCCCCCCCCAGCTGTCTTCGCTTCGTCCAGACC
AACATCTCCCGCCTCCTGCAGGAGACCTCCGAGCAGCTGGTGGCGCTGAA
GCCCTGGATCACTCGCCAGAACTTCTCCCGGTGCCTGGAGCTGCAGTGTC
AGCCCGACTCCTCAACCCTG SEQ ID NO:95
pMON32320.seq GCCGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGTCTGGAGGTAACGGATCCGGTGGCAATGGGAGCGGCGGAAATGGAAC
CCAGGACTGCTCCTTCCAACACAGCCCCATCTCCTCCGACTTCGCTGTCA
AAATCCGTGAGCTGTCTGACTACCTGCTTCAAGATTACCCAGTCACCGTG
GCCTCCAACCTGCAG SEQ ID NO:96
pMON32321.seq GCCGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGTCAGGCGGTAACGGCAGTGGAGGTAATGGCACCCAGGACTGCTCCTTT
CCAACACAGCCCCATCTCCTCCGACTTCGCTGTCAAAATCCGTGAGCTGT
CTGACTACCTGCTTCAAGATTACCCAGTCACCGTGGCCTCCAACCTGCAG
SEQ ID NO:97
pMON32322.seq GCCGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC TABLE 2-continued

GENE SEQUENCES

TGGAGCGCGTGAACACGGAGATACACTTTGTCACCAAATGTGCCTTTCAG
CCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGTCTGGCGGCAACGGCACCCAGGACTGCTCCTTCCAACACAGCCCCAT
CTCCTCCGACTTCGCTGTCAAAATCCGTGAGCTGTCTGACTACCTGCTTC
AAGATTACCCAGTCACCGTGGCCTCCAACCTGCAG SEQ ID NC:98
pMON32323.seq GCCTCCAAGATGCAAGGCTTGCTGGAGCGCGTGAACACGGAGATACACTT
TGTCACCAAATGTGCCTTTCAGCCCCCCCCCAGCTGTCTTCGCTTCGTCC
AGACCAACATCTCCCGCCTCCTGCAGGAGACCTCCGAGCAGCTGGTGGCG
CTGAAGCCCTGGATCACTCGCCAGAACTTCTCCCGGTGCCTGGAGCTGCA
GTGTCAGCCCGACTCCTCAACCCTGTCTGGAGGTAACGGATCCGGTGGCA
ATGGGAGCGGCGGAAATGGAACCCAGGACTGCTCCTTCCAACACAGCCCC
ATCTCCTCCGACTTCGCTGTCAAAATCCGTGAGCTGTCTGACTACCTGCT
TCAAGATTACCCAGTCACCGTGGCCTCCAACCTGCAGGACGAGGAGCTCT
GCGGGGGCCTCTGGCGGCTGGTCCTGGCACAGCGCTGGATGGAGCGGCTC
AAGACTGTCGCTGGG SEQ ID NO:99
pMON32324.seq GCCTCCAAGATGCAAGGCTTGCTGGAGCGCGTGAACACGGAGATACACTT
TGTCACCAAATGTGCCTTTCAGCCCCCCCCCAGCTGTCTTCGCTTCGTCC
AGACCAACATCTCCCGCCTCCTGCAGGAGACCTCCGAGCAGCTGGTGGCG
CTGAAGCCCTGGATCACTCGCCAGAACTTCTCCCGGTGCCTGGAGCTGCA
GTGTCAGCCCGACTCCTCAACCCTGTCTGGAGGTAACGGATCCGGAGGTA
ATGGCACCCAGGACTGCTCCTTCCAACACAGCCCCATCTCCTCCGACTTC
GCTGTCAAAATCCGTGAGCTGTCTGACTACCTGCTTCAAGATTACCCAGT
CACCGTGGCCTCCAACCTGCAGGACGAGGAGCTCTGCGGGGGCCTCTGGC
GGCTGGTCCTGGCACAGCGCTGGATGGAGCGGCTCAAGACTGTCGCTGGG
SEQ ID NO:100
pMON32325.seq GCCTCCAAGATGCAAGGCTTGCTGGAGCGCGTGAACACGGAGATACACTT
TGTCACCAAATGTGCCTTTCAGCCCCCCCCCAGCTGTCTTCGCTTCGTCC
AGACCAACATCTCCCGCCTCCTGCAGGAGACCTCCGAGCAGCTGGTGGCG
CTGAAGCCCTGGATCACTCGCCAGAACTTCTCCCGGTGCCTGGAGCTGCA
GTGTCAGCCCGACTCCTCAACCCTGTCTGGCGGCAACGGCACGCAGGACT
GCTCCTTCCAACACAGCCCCATCTCCTCCGACTTCGCTGTCAAAATCCGT
GAGCTGTCTGACTACCTGCTTCAAGATTACCCAGTCACCGTGGCCTCCAA
CCTGCAGGACGAGGAGCTCTGCGGGGGCCTCTGGCGGCTGGTCCTGGCAC
AGCGCTGGATGGAGCGGCTCAAGACTGTCGCTGGG SEQ ID NO:101
pMON32326.seq GCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGTCTGGAGGTAACGGCAGTGGTGGCAATGGGAGCGGTGGAAATGGAAC
CCAGGACTGCTCCTTCCAACACAGCCCCATCTCCTCCGACTTCGCTGTCA
AAATCCGTGAGCTGTCTGACTACCTGCTTCAAGATTACCCAGTCACCGTG
GCCTCCAACCTGCAGGACGAGGAGCTCTGCGGGGGCCTCTGGCGGCTGGT
CCTGGCACAGCGCTGGATGGAGCGGCTCAAGACTGTCGCTGGGTCCAAGA
TGCAAGGCTTGCTGGAGCGCGTGAACACGGAGATACACTTTGTCACCAAA
TGTGCCTTTCAGCCC SEQ ID NO:102
pMON32327.seq GCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGTCAGGCGGTAACGGCAGTGGAGGTAATGGCACCCAGGACTGCTCCTT
CCAACACAGCCCCATCTCCTCCGACTTCGCTGTCAAAATCCGTGAGCTGT
CTGACTACCTGCTTCAAGATTACCCAGTCACCGTGGCCTCCAACCTGCAG
GACGAGGAGCTCTGCGGGGGCCTCTGGCGGCTGGTCCTGGCACAGCGCTG
GATGGAGCGGCTCAAGACTGTCGCTGGGTCCAAGATGCAAGGCTTGCTGG
AGCGCGTGAACACGGAGATACACTTTGTCACCAAATGTGCCTTTCAGCCC
SEQ ID NO:103
pMON32328.seq GCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGTCTGGCGGCAACGGCACGCAGGACTGCTCCTTCCAACACAGCCCCAT
CTCCTCCGACTTCGCTGTCAAAATCCGTGAGCTGTCTGACTACCTGCTTC
AAGATTACCCAGTCACCGTGGCCTCCAACCTGCAGGACGAGGAGCTCTGC
GGGGGCCTCTGGCGGCTGGTCCTGGCACAGCGCTGGATGGAGCGGCTCAA
GACTGTCGCTGGGTCCAAGATGCAAGGCTTGCTGGAGCGCGTGAACACGG
AGATACACTTTGTCACCAAATGTGCCTTTCAGCCC SEQ ID NO:104

TABLE 2-continued

GENE SEQUENCES pMON32348.seq

GCCGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGTCTGGAGGTAGTGGATCCGGAGGTTCTGGCAACCCAGGACTGCTCCT
TCCAACACAGCCCCATCTCCTCCGACTTCGCTGTCAAAATCCGTGAGCTG
TCTGACTACCTGCTTCAAGATTACCCAGTCACCGTGGCCTCCAACCTGCAG
SEQ ID NO:105 pMON32350.seq

GCCGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGTCTGGAGGTAGTGGATCCGGTGGCAGTGGGAGCGGCGGATCTGGAAC
CCAGGACTGCTCCTTCCAACACAGCCCCATCTCCTCCGACTTCGCTGTCA
AAATCCGTGAGCTGTCTGACTACCTGCTTCAAGATTACCCAGTCACCGTG
GCCTCCAACCTGCAG SEQ ID NO:106

FLT3N.seq

CCATGGCCACCCAGGACTGCTCCTTCCAACACAGCCCCATCTCCTCCGAC
TTCGCTGTCAAAATCCGTGAGCTGTCTGACTACCTGCTTCAAGATTACCC
AGTCACCGTGGCCTCCAACCTGCAGGACGAGGAGCTCTGCGGGGGCCTCT
GGCGGCTGGTCCTGGCACAGCGCTGGATGGAGCGGCTCAAGACTGTCGCT
GGGTCCAAGATGCAAGGCTTGCTGGAGCGCGTGAACACGGAGATACACTT
TGTCACCAAATGTGCCTTTCAGCCCCCCCCCAGCTGTCTTCGCTTCGTCC
AGACCAACATCTCCCGCCTCCTGCAGGAGACCTCCGAGCAGCTGGTGGCG
CTGAAGCCCTGGATCACTCGCCAGAACTTCTCCCGGTGCCTGGAGCTGCA
GTGTCAGCCCGACTCCTCAACCCTGGGCGGTGGATCC SEQ ID NO:107

FLT3C.seq

GGATCCGGAGGTACCCAGGACTGCTCCTTCCAACACAGCCCCATCTCCTC
CGACTTCGCTGTCAAAATCCGTGAGCTGTCTGACTACCTGCTTCAAGATT
ACCCAGTCACCGTGGCCTCCAACCTGCAGGACGAGGAGCTCTGCGGGGGC
CTCTGGCGGCTGGTCCTGGCACAGCGCTGGATGGAGCGGCTCAAGACTGT
CGCTGGGTCCAAGATGCAAGGCTTGCTGGAGCGCGTGAACACGGAGATAC
ACTTTGTCACCAAATGTGCCTTTCAGCCCCCCCCCAGCTGTCTTCGCTTC
GTCCAGACCAACATCTCCCGCCTCCTGCAGGAGACCTCCGAGCAGCTGGT
GGCGCTGAAGCCCTGGATCACTCGCCAGAACTTCTCCCGGTGCCTGGAGC
TGCAGTGTCAGCCCGACTCCTCAACCCTGTAAGCTT SEQ ID NO:108

FLT7N.seq

CCATGGCCACCCAGGACTGCTCCTTCCAACACAGCCCCATCTCCTCCGAC
TTCGCTGTCAAAATCCGTGAGCTGTCTGACTACCTGCTTCAAGATTACCC
AGTCACCGTGGCCTCCAACCTGCAGGACGAGGAGCTCTGCGGGGGCCTCT
GGCGGCTGGTCCTGGCACAGCGCTGGATGGAGCGGCTCAAGACTGTCGCT
GGGTCCAAGATGCAAGGCTTGCTGGAGCGCGTGAACACGGAGATACACTT
TGTCACCAAATGTGCCTTTCAGCCCCCCCCCAGCTGTCTTCGCTTCGTCC
AGACCAACATCTCCCGCCTCCTGCAGGAGACCTCCGAGCAGCTGGTGGCG
CTGAAGCCCTGGATCACTCGCCAGAACTTCTCCCGGTGCCTGGAGCTGCA
GTGTCAGCCCGACTCCTCAACCCTGGGCGGTGGGTCAGGAGGTGGATCC
SEQ ID NO:109

FLT4C.seq

GGATCCGGAGGTGGCACCCAGGACTGCTCCTTCCAACACAGCCCCATCTC
CTCCGACTTCGCTGTCAAAATCCGTGAGCTGTCTGACTACCTGCTTCAAG
ATTACCCAGTCACCGTGGCCTCCAACCTGCAGGACGAGGAGCTCTGCGGG
GGCCTCTGGCGGCTGGTCCTGGCACAGCGCTGGATGGAGCGGCTCAAGAC
TGTCGCTGGGTCCAAGATGCAAGGCTTGCTGGAGCGCGTGAACACGGAGA
TACACTTTGTCACCAAATGTGCCTTTCAGCCCCCCCCCAGCTGTCTTCGC
TTCGTCCAGACCAACATCTCCCGCCTCCTGCAGGAGACCTCCGAGCAGCT
GGTGGCGCTGAAGCCCTGGATCACTCGCCAGAACTTCTCCCGGTGCCTGG
AGCTGCAGTGTCAGCCCGACTCCTCAACCCTGTAAGCTT
SEQ ID NO:110

FLT11N.seq

CCATGGCCACCCAGGACTGCTCCTTCCAACACAGCCCCATCTCCTCCGAC
TTCGCTGTCAAAATCCGTGAGCTGTCTGACTACCTGCTTCAAGATTACCC
AGTCACCGTGGCCTCCAACCTGCAGGACGAGGAGCTCTGCGGGGGCCTCT
GGCGGCTGGTCCTGGCACAGCGCTGGATGGAGCGGCTCAAGACTGTCGCT
GGGTCCAAGATGCAAGGCTTGCTGGAGCGCGTGAACACGGAGATACACTT

TABLE 2-continued

GENE SEQUENCES

TGTCACCAAATGTGCCTTTCAGCCCCCCCCCAGCTGTCTTCGCTTCGTCC
AGACCAACATCTCCCGCCTCCTGCAGGAGACCTCCGAGCAGCTGGTGGCG
CTGAAGCCCTGGATCACTCGCCAGAACTTCTCCCGGTGCCTGGAGCTGCA
GTGTCAGCCCGACTCCTCAACCCTGGGCGGTGGGTCAGGAGGTGGGTCAG
GAGGTGGATCC SEQ ID NO:111
FLT10C.seq GGATCCGGAGGTGGCTCAGGGGGAGGTAGTGGTACCCAGGACTGCTCCTT
CCAACACAGCCCCATCTCCTCCGACTTCGCTGTCAAAATCCGTGAGCTGT
CTGACTACCTGCTTCAAGATTACCCAGTCACCGTGGCCTCCAACCTGCAG
GACGAGGAGCTCTGCGGGGGCCTCTGGCGGCTGGTCCTGGCACAGCGCTG
GATGGAGCGGCTCAAGACTGTCGCTGGGTCCAAGATGCAAGGCTTGCTGG
AGCGCGTGAACACGGAGATACACTTTGTCACCAAATGTGCCTTTCAGCCC
CCCCCCAGCTGTCTTCGCTTCGTCAGACCAACATCTCCCGCCTCCTGCA
GGAGACCTCCGAGCAGCTGGTGGCGCTGAAGCCCTGGATCACTCGCCAGA
ACTTCTCCCGGTGCCTGGAGCTGCAGTGTCAGCCCGACTCCTCAACCCTG
TAAGCTT SEQ ID NO:112
pMON32365.seq GCCGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGGGCGGTGGATCCGGAGGTACCCAGGACTGCTCCTTCCAACACAGCCC
CATCTCCTCCGACTTCGCTGTCAAAATCCGTGAGCTGTCTGACTACCTGC
TTCAAGATTACCCAGTCACCGTGGCCTCCAACCTGCAG
SEQ ID NO:113
pMON32366.seq GCCGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGGGCGGTGGATCCGGAGGTGGCACCCAGGACTGCTCCTTCCAACACAG
CCCCATCTCCTCCGACTTCGCTGTCAAAATCCGTGAGCTGTCTGACTACC
TGCTTCAAGATTACCCAGTCACCGTGGCCTCCAACCTGCAG
SEQ ID NO:114
pMON32367.seq GCCGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGGGCGGTGGGTCAGGAGGTGGATCCGGAGGTACCCAGGACTGCTCCTT
CCAACACAGCCCCATCTCCTCCGACTTCGCTGTCAAAATCCGTGAGCTGT
CTGACTACCTGCTTCAAGATTACCCAGTCACCGTGGCCTCCAACCTGCAG
SEQ ID NO:115
pMON32368.seq GCCGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGGGCGGTGGATCCGGAGGTGCTCAGGGGAGGTAGTGGTACCCAGGA
CTGCTCCTTCCAACACAGCCCCATCTCCTCCGACTTCGCTGTCAAAATCC
GTGAGCTGTCTGACTACCTGCTTCAAGATTACCCAGTCACCGTGGCCTCC
AACCTGCAG SBQ ID NO:116
pMON32369.seq GCCGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCCCCCCCCAGCTGTCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGGGCGGTGGGTCAGGAGGTGGGTCAGGAGGTGGATCCGGAGGTGGCAC
CCAGGACTGCTCCTTCCAACACAGCCCCATCTCCTCCGACTTCGCTGTCA
AAATCCGTGAGCTGTCTGACTACCTGCTTCAAGATTACCCAGTCACCGTG
GCCTCCAACCTGCAG SEQ ID NO:117

TABLE 2-continued

GENE SEQUENCES pMON32370.seq

GCCGACGAGGAGCTCTGCGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCCCCCCCCAGCTGCCTTCGCTTCGTCCAGACCAACATCTCCCGCCTCCT
GCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACC
CTGGGCGGTGGGTCAGGAGGTGGGTCAGGAGGTGGATCCGGAGGTGGCTC
AGGGGGAGGTAGTGGTACCCAGGACTGCTCCTTCCAACACAGCCCCATCT
CCTCCGACTTCGCTGTCAAAATCCGTGAGCTGTCTGACTACCTGCTTCAA
GATTACCCAGTCACCGTGGCCTCCAACCTGCAG SEQ ID NO:118 pMON30247.seq

GCTAACTGCTCTATAATGATCGATGAAATTATACATCACTTAAAGAGACC
ACCTGCACCTTTGCTGGACCCGAACAACCTCAATGACGAAGACGTCTCTA
TCCTGATGGACCGAAACCTTCGACTTCCAAACCTGGAGAGCTTCGTAAGG
GCTGTCAAGAACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCACCCAGGAC
TGCTCCTTCCAACACAGCCCCATCTCCTCCGACTTCGCTGTCAAAATCCG
TGAGCTGTCTGACTACCTGCTTCAAGATTACCCAGTCACCGTGGCCTCCA
ACCTGCAGGACGAGGAGCTCTGCGGGGCGCTCTGGCGGCTGGTCCTGGCA
CAGCGCTGGATGGAGCGGCTCAAGACTGTCGCTGGGTCCAAGATGCAAGG
CTTGCTGGAGCGCGTGAACACGGAGATACACTTTGTCACCAAATGTGCCT
TTCAGCCCCCCCCCAGCTGTCTTCGCTTCGTCCAGACCAACATCTCCCGC
CTCCTGCAGGAGACCTCCGAGCAGCTGGTGGCGCTGAAGCCCTGGATCAC
TCGCCAGAACTTCTCCCGGTGCCTGGAGCTGCAGTGTCAGCCC
SEQ ID NO:119 pMON30248.seq

GCTAACTGCTCTATAATGATCGATGAAATTATACATCACTTAAAGAGACC
ACCTGCACCTTTGCTGGACCCGAACAACCTCAATGACGAAGACGTCTCTA
TCCTGATGGACCGAAACCTTCGACTTCCAAACCTGGAGAGCTTCGTAAGG
GCTGTCAAGAACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCACCCAGGAC
TGCTCCTTCCAACACAGCCCCATCTCCTCCGACTTCGCTGTCAAAATCCG
TGAGCTGTCTGACTACCTGCTTCAAGATTACCCAGTCACCGTGGCCTCCA
ACCTGCAGGACGAGGAGCTCTGCGGGGCGCTCTGGCGGCTGGTCCTGGCA
CAGCGCTGGATGGAGCGGCTCAAGACTGTCGCTGGGTCCAAGATGCAAGG
CTTGCTGGAGCGCGTGAACACGGAGATACACTTTGTCACCAAATGTGCCT
TTCAGCCCCCCCCCAGCTGTCTTCGCTTCGTCCAGACCAACATCTCCCGC
CTCCTGCAGGAGACCTCCGAGCAGCTGGTGGCGCTGAAGCCCTGGATCAC
TCGCCAGAACTTCTCCCGGTGCCTGGAGCTGCAGTGTCAGCCCGACTCCT
CAACCCTG SEQ ID NO:120 pMON32332.seq

GCTAACTGCTCTATAATGATCGATGAAATTATACATCACTTAAAGAGACC
ACCTGCACCTTTGCTGGACCCGAACAACCTCAATGACGAAGACGTCTCTA
TCCTGATGGACCGAAACCTTCGACTTCCAAACCTGGAGAGCTTCGTAAGG
GCTGTCAAGAACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGACGAGGAG
CTCTGCGGGGCCTCTGGCGGCTGGTCCTGGCACAGCGCTGGATGGAGCGG
CTCAAGACTGTCGCTGGGTCCAAGATGCAAGGCTTGCTGGAGCGCGTGA
ACACGGAGATACACTTTGTCACCAAATGTGCCTTTCAGCCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGTCAGGCGGT
AACGGCAGTGGAGGTAATGGCACCCAGGACTGCTCCTTCCAACACAGCCC
CATCTCCTCCGACTTCGCTGTCAAAATCCGTGAGCTGTCTGACTACCTGC
TTCAAGATTACCCAGTCACCGTGGCCTCCAACCTGCAG
SEQ ID NO:121 pMON32333.seq

GCTAACTGCTCTATAATGATCGATGAAATTATACATCACTTAAAGAGACC
ACCTGCACCTTTGCTGGACCCGAACAACCTCAATGACGAAGACGTCTCTA

TABLE 2-continued

GENE SEQUENCES

TCCTGATGGACCGAAACCTTCGACTTCCAAACCTGGAGAGCTTCGTAAGG
GCTGTCAAGAACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGACGAGGAG
CTCTGCGGGGCCTCTGGCGGCTGGTCCTGGCACAGCGCTGGATGGAGCG
GCTCAAGACTGTCGCTGGGTCCAAGATGCAAGGCTTGCTGGAGCGCGTGA
ACACGGAGATACACTTTGTCACCAAATGTGCCTTTCAGCCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGTCTGGAGGT
AACGGATCCGGTGGCAATGGGAGCGGCGGAAATGGAACCCAGGACTGCTC
CTTCCAACACAGCCCCATCTCCTCCGACTTCGCTGTCAAAATCCGTGAGC
TGTCTGACTACCTGCTTCAAGATTACCCAGTCACCGTGGCCTCCAACCTG
CAG SEQ ID NO:122
pMON32334.seq GCTAACTGCTCTATAATGATCGATGAAATTATACATCACTTAAAGAGACC
ACCTGCACCTTTGCTGGACCCGAACAACCTCAATGACGAAGACGTCTCTA
TCCTGATGGACCGAAACCTTCGACTTCCAAACCTGGAGAGCTTCGTAAGG
GCTGTCAAGAACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCTCCAAGATG
CAAGGCTTGCTGGAGCGCGTGAACACGGAGATACACTTTGTCACCAAATG
TGCCTTTCAGCCCCCCCCCAGCTGTCTTCGCTTCGTCCAGACCAACATCT
CCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGA
CTCCTCAACCCTGTCTGGCGGCAACGGCACGCAGGACTGCTCCTTCCAAC
ACAGCCCCATCTCCTCCGACTTCGCTGTCAAAATCCGTGAGCTGTCTGAC
TACCTGCTTCAAGATTACCCAGTCACCGTGGCCTCCAACCTGCAGGACGA
GGAGCTCTGCGGGGCCTCTGGCGGCTGGTCCTGGCACAGCGCTGGATGG
AGCGGCTCAAGACTGTCGCTGGG SEQ ID NO:123
pMON32335.seq GCTAACTGCTCTATAATGATCGATGAAATTATACATCACTTAAAGAGACC
ACCTGCACCTTTGCTGGACCCGAACAACCTCAATGACGAAGACGTCTCTA
TCCTGATGGACCGAAACCTTCGACTTCCAAACCTGGAGAGCTTCGTAAGG
GCTGTCAAGAACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCTCCAAGATG
CAAGGCTTGCTGGAGCGCGTGAACACGGAGATACACTTTGTCACCAAATG
TGCCTTTCAGCCCCCCCCCAGCTGTCTTCGCTTCGTCCAGACCAACATCT
CCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGA
CTCCTCAACCCTGTCTGGAGGTAACGGATCCGGAGGTAATGGCACCCAGG
ACTGCTCCTTCCAACACAGCCCCATCTCCTCCGACTTCGCTGTCAAAATC
CGTGAGCTGTCTGACTACCTGCTTCAAGATTACCCAGTCACCGTGGCCTC
CAACCTGCAGGACGAGGAGCTCTGCGGGGCCTCTGGCGGCTGGTCCTGG
CACAGCGCTGGATGGAGCGGCTCAAGACTGTCGCTGGG
SEQ ID NO: 124
pMON32336.seq GCTAACTGCTCTATAATGATCGATGAAATTATACATCACTTAAAGAGACC
ACCTGCACCTTTGCTGGACCCGAACAACCTCAATGACGAAGACGTCTCTA
TCCTGATGGACCGAAACCTTCGACTTCCAAACCTGGAGAGCTTCGTAAGG
GCTGTCAAGAACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCTCCAAGATG
CAAGGCTTGCTGGAGCGCGTGAACACGGAGATACACTTTGTCACCAAATG
TGCCTTTCAGCCCCCCCCCAGCTGTCTTCGCTTCGTCCAGACCAACATCT
CCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGA
CTCCTCAACCCTGTCTGGAGGTAACGGATCCGGTGGCAATGGGAGCGGCG
GAAATGGAACCCAGGACTGCTCCTTCCAACACAGCCCCATCTCCTCCGAC
TTCGCTGTCAAAATCCGTGAGCTGTCTGACTACCTGCTTCAAGATTACCC
AGTCACCGTGGCCTCCAACCTGCAGGACGAGGAGCTCTGCGGGGCCTCT

TABLE 2-continued

GENE SEQUENCES

GGCGGCTGGTCCTGGCACAGCGCTGGATGGAGCGGCTCAAGACTGTCGCT
GGG SEQ ID NO:125
pMON32337.seq GCTAACTGCTCTATAATGATCGATGAAATTATACATCACTTAAAGAGACC
ACCTGCACCTTTGCTGGACCCGAACAACCTCAATGACGAAGACGTCTCTA
TCCTGATGGACCGAAACCTTCGACTTCCAAACCTGGAGAGCTTCGTAAGG
GCTGTCAAGAACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGTCTGCCGGC
AACGGCACCCAGGACTGCTCCTTCCAACACAGCCCCATCTCCTCCGACTT
CGCTGTCAAAATCCGTGAGCTGTCTGACTACCTGCTTCAAGATTACCCAG
TCACCGTGGCCTCCAACCTGCAGGACGAGGAGCTCTGCGGGGGCCTCTGG
CGGCTGGTCCTGGCACAGCGCTGGATGGAGCGGCTCAAGACTGTCGCTGG
GTCCAAGATGCAAGGCTTGCTGGAGCGCGTGAACACGGAGATACACTTTG
TCACCAAATGTGCCTTTCAGCCC SEQ ID NO:126
pMON32338.seq GCTAACTGCTCTATAATGATCGATGAAATTATACATCACTTAAAGAGACC
ACCTGCACCTTTGCTGGACCCGAACAACCTCAATGACGAAGACGTCTCTA
TCCTGATGGACCGAAACCTTCGACTTCCAAACCTGGAGAGCTTCGTAAGG
GCTGTCAAGAACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGTCAGGCGGT
AACGGCAGTGGAGGTAATGGCACCCAGGACTGCTCCTTCCAACACAGCCC
CATCTCCTCCGACTTCGCTGTCAAAATCCGTGAGCTGTCTGACTACCTGC
TTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCT
CAAGACTGTCGCTGGGTCCAAGATGCAAGGCTTGCTGGAGCGCGTGAACA
CGGAGATACACTTTGTCACCAAATGTGCCTTTCAGCCC
SEQ ID NO:127
pMON32339.seq GCTAACTGCTCTATAATGATCGATGAAATTATACATCACTTAAAGAGACC
ACCTGCACCTTTGCTGGACCCGAACAACCTCAATGACGAAGACGTCTCTA
TCCTGATGGACCGAAACCTTCGACTTCCAAACCTGGAGAGCTTCGTAAGG
GCTGTCAAGAACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGTCTGGAGGT
AACGGCAGTGGTGGTAATGGGAGCGGCGGAAATGGAACCCAGGACTGCTC
CTTCCAACACAGCCCCATCTCCTCCGACTTCGCTGTCAAAATCCGTGAGC
TGTCTGACTACCTGCTTCAAGATTACCCAGTCACCGTGGCCTCCAACCTG
CAGGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCC SEQ ID NO:128
pMON32364.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCGACTCAGGAC
TGTTCTTTCCAACACAGCCCCATCTCCTCCGACTTCGCTGTCAAAATCCG
TGAGCTGTCTGACTACCTGCTTCAAGATTACCCAGTCACCGTGGCCTCCA

TABLE 2-continued

GENE SEQUENCES

ACCTGCAGGACGAGGAGCTCTGCGGGGGCCTCTGGCGGCTGGTCCTGGCA
CAGCGCTGGATGGAGCGGCTCAAGACTGTCGCTGGGTCCAAGATGCAAGG
CTTGCTGGAGCGCGTGAACACGGAGATACACTTTGTCACCAAATGTGCCT
TTCAGCCCCCCCCAGCTGTCTTCGCTTCGTCCAGACCAACATCTCCCGC
CTCCTGCAGGAGACCTCCGAGCAGCTGGTGGCGCTGAAGCCCTGGATCAC
TCGCCAGAACTTCTCCCGGTGCCTGGAGCTGCAGTGTCAGCCC
SEQ ID NO:129
pMON32377.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCAACCCAGGAC
TGCTCTTTTCAACACAGCCCCATCTCCTCCGACTTCGCTGTCAAAATCCG
TGAGCTGTCTGACTACCTGCTTCAAGATTACCCAGTCACCGTGGCCTCCA
ACCTGCAGGACGAGGAGCTCTGCGGGGGCCTCTGGCGGCTGGTCCTGGCA
CAGCGCTGGATGGAGCGGCTCAAGACTGTCGCTGGGTCCAAGATGCAAGG
CTTGCTGGAGCGCGTGAACACGGAGATACACTTTGTCACCAAATGTGCCT
TTCAGCCCCCCCCAGCTGTCTTCGCTTCGTCCAGACCAACATCTCCCGC
CTCCTGCAGGAGACCTCCGAGCAGCTGGTGGCGCTGAAGCCCTGGATCAC
TCGCCAGAACTTCTCCCGGTGCCTGGAGCTGCAGTGTCAGCCCGACTCCT
CAACCCTG SEQ ID NO:130
pMON32392.seq GCCACTCAGGACTGCTCCTTCCAACACAGCCCCATCTCCTCCGACTTCGC
TGTCAAAATCCGTGAGCTGTCTGACTACCTGCTTCAAGATTACCCAGTCA
CCGTGGCCTCCAACCTGCAGGACGAGGAGCTCTGCGGGGCCTCTGGCGG
CTGGTCCTGGCACAGCGCTGGATGGAGCGGCTCAAGACTGTCGCTGGGTC
CAAGATGCAAGGCTTGCTGGAGCGCGTGAACACGGAGATACACTTTGTCA
CCAAATGTGCCTTTCAGCCCCCCCCAGCTGTCTTCGCTTCGTCCAGACC
AACATCTCCCGCCTCCTGCAGGAGACCTCCGAGCAGCTGGTGGCGCTGAA
GCCCTGGATCACTCGCCAGAACTTCTCCCGGTGCCTGGAGCTGCAGTGTC
AGCCCTACGTAGAGGGCGGTGGAGGCTCCCCGGGTGAACCGTCTGGTCCA
ATCTCTACTATCAACCCGTCTCCTCCGTCTAAAGAATCTCATAAATCTCC
AAACATGGCTAACTGCTCTATAATGATCGATGAAATTATACATCACTTAA
AGAGACCACCTAACCCTTTGCTGGACCCGAACAACCTCAATTCTGAAGAC
ATGGATATCCTGATGGAACGAAACCTTCGAACTCCAAACCTGCTCGCATT
CGTAAGGGCTGTCAAGCACTTAGAAAATGCATCAGGTATTGAGGCAATTC
TTCGTAATCTCCAACCATGTCTGCCCTCTGCCACGGCCGCACCCTCTCGA
CATCCAATCATCATCAAGGCAGGTGACTGGCAAGAATTCCGGGAAAAACT
GACGTTCTATCTGGTTACCCTTGAGCAAGCGCAGGAACAACAG
SEQ ID NO:131
pMON32352.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCCAACATGGCCGACGAGGAG
CTCTGCGGGGCCTCTGGCGGCTGGTCCTGGCACAGCGCTGGATGGAGCG
GCTCAAGACTGTCGCTGGGTCCAAGATGCAAGGCTTGCTGGAGCGCGTGA
ACACGGAGATACACTTTGTCACCAAATGTGCCTTTCAGCCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGTCAGGCGGT
AACGGCAGTGGAGGTAATGGCACCCAGGACTGCTCCTTCCAACACAGCCC
CATCTCCTCCGACTTCGCTGTCAAAATCCGTGAGCTGTCTGACTACCTGC
TTCAAGATTACCCAGTCACCGTGGCCTCCAACCTGCAG
SEQ ID NO:132
pMON32353.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG

TABLE 2-continued

GENE SEQUENCES

TGGAGGCTCCCCGGGTGAACCGTCTGGTCCAATCTCTACTATCAACCCGT
CTCCTCCGTCTAAAGAATCTCATAAATCTCCAAACATGGCCGACGAGGAG
CTCTGCGGGGGCCTCTGGCGGCTGGTCCTGGCACAGCGCTGGATGGAGCG
GCTCAAGACTGTCGCTGGGTCCAAGATGCAAGGCTTGCTGGAGCGCGTGA
ACACGGAGATACACTTTGTCACCAAATGTGCCTTTCAGCCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGTCTGGAGGT
AACGGATCCGGTGGCAATGGGAGCGGCGGAAATGGAACCCAGGACTGCTC
CTTCCAACACAGCCCCATCTCCTCCGACTTCGCTGTCAAAATCCGTGAGC
TGTCTGACTACCTGCTTCAAGATTACCCAGTCACCGTGGCCTCCAACCTG
CAG SEQ ID NO:133
pMON32354.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCTCCAAGATG
CAAGGCTTGCTGGAGCGCGTGAACACGGAGATACACTTTGTCACCAAATG
TGCCTTTCAGCCCCCCCCCAGCTGTCTTCGCTTCGTCCAGACCAACATCT
CCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGA
CTCCTCAACCCTGTCTGGCGGCAACGGCACGCAGGACTGCTCCTTCCAAC
ACAGCCCCATCTCCTCCGACTTCGCTGTCAAAATCCGTGAGCTGTCTGAC
TACCTGCTTCAAGATTACCCAGTCACCGTGGCCTCCAACCTGCAGGACGA
GGAGCTCTGCGGGGCCTCTGGCGGCTGGTCCTGGCACAGCGCTGGATGG
AGCGGCTCAAGACTGTCGCTGGG SEQ ID NO:134
pMON32355.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCTCCAAGATG
CAAGGCTTGCTGGAGCGCGTGAACACGGAGATACACTTTGTCACCAAATG
TGCCTTTCAGCCCCCCCCCAGCTGTCTTCGCTTCGTCCAGACCAACATCT
CCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGA
CTCCTCAACCCTGTCTGGAGGTAACGGATCCGGTGGCAATGGGAGCGGCG
GAAATGGAACCCAGGACTGCTCCTTCCAACACAGCCCCATCTCCTCCGAC
TTCGCTGTCAAAATCCGTGAGCTGTCTGACTACCTGCTTCAAGATTACCC
AGTCACCGTGGCCTCCAACCTGCAGGACGAGGAGCTCTGCGGGGCCTCT
GGCGGCTGGTCCTGGCACAGCGCTGGATGGAGCGGCTCAAGACTGTCGCT
GGG SEQ ID NO:135
pMON32356.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCTCCAAGATG
CAAGGCTTGCTGGAGCGCGTGAACACGGAGATACACTTTGTCACCAAATG
TGCCTTTCAGCCCCCCCCCAGCTGTCTTCGCTTCGTCCAGACCAACATCT
CCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGA
CTCCTCAACCCTGTCTGGAGGTAACGGATCCGGTGGCAATGGGAGCGGCG
GAAATGGAACCCAGGACTGCTCCTTCCAACACAGCCCCATCTCCTCCGAC
TTCGCTGTCAAAATCCGTGAGCTGTCTGACTACCTGCTTCAAGATTACCC
AGTCACCGTGGCCTCCAACCTGCAGGACGAGGAGCTCTGCGGGGGCCTCT
GGCGGCTGGTCCTGGCACAGCGCTGGATGGAGCGGCTCAAGACTGTCGCT
GGG SEQ ID NO:136

TABLE 2-continued

GENE SEQUENCES pMON32357.seq

GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGTCTGGCGGC
AACGGCACGCAGGACTGCTCCTTCCAACACAGCCCCATCTCCTCCGACTT
CGCTGTCAAAATCCGTGAGCTGTCTGACTACCTGCTTCAAGATTACCCAG
TCACCGTGGCCTCCAACCTGCAGGACGAGGAGCTCTGCGGGGGCCTCTGG
CGGCTGGTCCTGGCACAGCGCTGGATGGAGCGGCTCAAGACTGTCGCTGG
GTCCAAGATGCAAGGCTTGCTGGAGCGCGTGAACACGGAGATACACTTTG
TCACCAAATGTGCCTTTCAGCCC SEQ ID NO:137 pMON32358.seq

GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGTCAGGCGGT
AACGGCAGTGGAGGTAATGGCACCCAGGACTGCTCCTTCCAACACAGCCC
CATCTCCTCCGACTTCGCTGTCAAAATCCGTGAGCTGTCTGACTACCTGC
TTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCT
CAAGACTGTCGCTGGGTCCAAGATGCAAGGCTTGCTGGAGCGCGTGAACA
CGGAGATACACTTTGTCACCAAATGTGCCTTTCAGCCC
SEQ ID NO:138 pMON32359.seq

GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGTCTGGAGGT
AACGGCAGTGGTGGCAATGGGAGCGGCGGAAATGGAACCCAGGACTGCTC
CTTCCAACACAGCCCCATCTCCTCCGACTTCGCTGTCAAAATCCGTGAGC
TGTCTGACTACCTGCTTCAAGATTACCCAGTCACCGTGGCCTCCAACCTG
CAGGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCC SEQ ID NO:139 pMON32360.seq

GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCCAACATGGCCGACGAGGAG
CTCTGCGGGGGCCTCTGGCGGCTGGTCCTGGCACAGCGCTGGATGGAGCG
GCTCAAGACTGTCGCTGGGTCCAAGATGCAAGGCTTGCTGGAGCGCGTGA
ACACGGAGATACACTTTGTCACCAAATGTGCCTTTCAGCCCCCCCCCAGC
TGTCTTCGCTTCGTCCAGACCAACATCTCCCGCCTCCTGCAGGAGACCTC

TABLE 2-continued

GENE SEQUENCES

CGAGCAGCTGGTGGCGCTGAAGCCCTGGATCACTCGCCAGAACTTCTCCC
GGTGCCTGGAGCTGCAGTGTCAGCCCGACTCCTCAACCCTGTCTGGAGGT
AGTGGATCCGGAGGTTCTGGCACCCAGGACTGCTCCTTCCAACACAGCCC
CATCTCCTCCGACTTCGCTGTCAAAATCCGTGAGCTGTCTGACTACCTGC
TTCAAGATTACCCAGTCACCGTGGCCTCCAACCTGCAG
SEQ ID NO:140
pMON32362.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGACGAGGAG
CTCTGCGGGGGCCTCTGGCGGCTGGTCCTGGCACAGCGCTGGATGGAGCG
GCTCAAGACTGTCGCTGGGTCCAAGATGCAAGGCTTGCTGGAGCGCGTGA
ACACGGAGATACACTTTGTCACCAAATGTGCCTTTCAGCCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGTCTGGAGGT
AGTGGATCCGGTGGCAGTGGGAGCGGCGGATCTGGAACCCAGGACTGCTC
CTTCCAACACAGCCCCATCTCCTCCGACTTCGCTGTCAAAATCCGTGAGC
TGTCTGACTACCTGCTTCAAGATTACCCAGTCACCGTGGCCTCCAACCTG
CAG SEQ ID NO:141
pMON32393.seq GCCACCCAGGACTGCTCCTTCCAACACAGCCCCATCTCCTCCGACTTCGC
TGTCAAAATCCGTGAGCTGTCTGACTACCTGCTTCAAGATTACCCAGTCA
CCGTGGCCTCCAACCTGCAGGACGAGGAGCTCTGCGGGGCCTCTGGCGG
CTGGTCCTGGCACAGCGCTGGATGGAGCGGCTCAAGACTGTCGCTGGGTC
CAAGATGCAAGGCTTGCTGGAGCGCGTGAACACGGAGATACACTTTGTCA
CCAAATGTGCCTTTCAGCCCCCCCCCAGCTGTCTTCGCTTCGTCCAGACC
AACATCTCCCGCCTCCTGCAGGAGACCTCCGAGCAGCTGGTGGCGCTGAA
GCCCTGGATCACTCGCCAGAACTTCTCCCGGTGCCTGGAGCTGCAGTGTC
AGCCCGACTCCTCAACCCTGTACGTAGAGGGCGGTGGAGGCTCCCCGGGT
GAACCGTCTGGTCCAATCTCTACTATCAACCCGTCTCCTCCGTCTAAAGA
ATCTCATAAATCTCCAAACATGGCTAACTGCTCTATAATGATCGATGAAA
TTATACATCACTTAAAGAGACCACCTAACCCTTTGCTGGACCCGAACAAC
CTCAATTCTGAAGACATGGATATCCTGATGGAACGAAACCTTCGAACTCC
AAACCTGCTCGCATTCGTAAGGGCTGTCAAGCACTTAGAAAATGCATCAG
GTATTGAGGCAATTCTTCGTAATCTCCAACCATGTCTGCCCTCTGCCACG
GCCGCACCCTCTCGACATCCAATCATCATCAAGGCAGGTGACTGGCAAGA
ATTCCGGGAAAAACTGACGTTCTATCTGGTTACCCTTGAGCAAGCGCAGG
AACAACAG SEQ ID NO:142
pMON32371.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGACGAGGAG
CTCTGCGGGGGCCTCTGGCGGCTGGTCCTGGCACAGCGCTGGATGGAGCG
GCTCAAGACTGTCGCTGGGTCCAAGATGCAAGGCTTGCTGGAGCGCGTGA
ACACGGAGATACACTTTGTCACCAAATGTGCCTTTCAGCCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGGGCGGTGGA
TCCGGAGGTACCCAGGACTGCTCCTTCCAACACAGCCCCATCTCCTCCGA
CTTCGCTGTCAAAATCCGTGAGCTGTCTGACTACCTGCTTCAAGATTACC
CAGTCACCGTGGCCTCCAACCTGCAG SEQ ID NO:143
pMON32372.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT

TABLE 2-continued

GENE SEQUENCES

CTCCTCCGTCTAAAGAATCTCATAAATCTCCAAACATGGCCGACGAGGAG
CTCTGCGGGGGCCTCTGGCGGCTGGTCCTGGCACAGCGCTGGATGGAGCG
GCTCAAGACTGTCGCTGGGTCCAAGATGCAAGGCTTGCTGGAGCGCGTGA
ACACGGAGATACACTTTGTCACCAAATGTGCCTTTCAGCCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGGGCGGTGGA
TCCGGAGGTGGCACCCAGGACTGCTCCTTCCAACACAGCCCCATCTCCTC
CGACTTCGCTGTCAAAATCCGTGAGCTGTCTGACTACCTGCTTCAAGATT
ACCCAGTCACCGTGGCCTCCAACCTGCAG SEQ ID NO:144
pMON32373.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGACGAGGAG
CTCTGCGGGGGCCTCTGGCGGCTGGTCCTGGCACAGCGCTGGATGGAGCG
GCTCAAGACTGTCGCTGGGTCCAAGATGCAAGGCTTGCTGGAGCGCGTGA
ACACGGAGATACACTTTGTCACCAAATGTGCCTTTCAGCCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGGGCGGTGGG
TCAGGAGGTGGATCCGGAGGTACCCAGGACTGCTCCTTCCAACACAGCCC
CATCTCCTCCGACTTCGCTGTCAAAATCCGTGAGCTGTCTGACTACCTGC
TTCAAGATTACCCAGTCACCGTGGCCTCCAACCTGCAG
SEQ ID NO:145
pMON32374.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGACGAGGAG
CTCTGCGGGGGCCTCTGGCGGCTGGTCCTGGCACAGCGCTGGATGGAGCG
GCTCAAGACTGTCGCTGGGTCCAAGATGCAAGGCTTGCTGGAGCGCGTGA
ACACGGAGATACACTTTGTCACCAAATGTGCCTTTCAGCCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGGGCGGTGGA
TCCGGAGGTGGCTCAGGGGAGGTAGTGGTACCCAGGACTGCTCCTTCCA
ACACAGCCCCATCTCCTCCGACTTCGCTGTCAAAATCCGTGAGCTGTCTG
ACTACCTGCTTCAAGATTACCCAGTCACCGTGGCCTCCAACCTGCAG
SEQ ID NO:146
pMON32375.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGACGAGGAG
CTCTGCGGGGGCCTCTGGCGGCTGGTCCTGGCACAGCGCTGGATGGAGCG
GCTCAAGACTGTCGCTGGGTCCAAGATGCAAGGCTTGCTGGAGCGCGTGA
ACACGGAGATACACTTTGTCACCAAATGTGCCTTTCAGCCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGGGCGGTGGG
TCAGGAGGTGGGTCAGGAGGTGGATCCGGAGGTGGCACCCAGGACTGCTC
CTTCCAACACAGCCCCATCTCCTCCGACTTCGCTGTCAAAATCCGTGAGC
TGTCTGACTACCTGCTTCAAGATTACCCAGTCACCGTGGCCTCCAACCTG
CAG SEQ ID NO:147
pMON32376.seq GCTAACTGCTCTATAATGATCGATGAAATTATACATCACTTAAAGAGACC
ACCTAACCCTTTGCTGGACCCGAACAACCTCAATTCTGAAGACATGGATA

TABLE 2-continued

GENE SEQUENCES

TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGACGAGGAG
CTCTGCGGGGCCTCTGGCGGCTGGTCCTGGCACAGCGCTGGATGGAGCG
GCTCAAGACTGTCGCTGGGTCCAAGATGCAAGGCTTGCTGGAGCGCGTGA
ACACGGAGATACACTTTGTCACCAAATGTGCCTTTCAGCCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGGGCGGTGGG
TCAGGAGGTGGGTCAGGAGGTGGATCCGGAGGTGGCTCAGGGGGAGGTAG
TGGTACCCAGGACTGCTCCTTCCAACACAGCCCCATCTCCTCCGACTTCG
CTGTCAAAATCCGTGAGCTGTCTGACTACCTGCTTCAAGATTACCCAGTC
ACCGTGGCCTCCAACCTGCAG SEQ ID NO:148
pMON32378.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCTCCAAGATG
CAAGGCTTGCTGGAGCGCGTGAACACGGAGATACACTTTGTCACCAAATG
TGCCTTTCAGCCCCCCCCCAGCTGTCTTCGCTTCGTCCAGACCAACATCT
CCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGA
CTCCTCAACCCTGGGCGGTGGATCCGGAGGTACCCAGGACTGCTCCTTCC
AACACAGCCCCATCTCCTCCGACTTCGCTGTCAAAATCCGTGAGCTGTCT
GACTACCTGCTTCAAGATTACCCAGTCACCGTGGCCTCCAACCTGCAGGA
CGAGGAGCTCTGCGGGGCCTCTGGCGGCTGGTCCTGGCACAGCGCTGGA
TGGAGCGGCTCAAGACTGTCGCTGGG SEQ ID NO:149
pMON32379.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCTCCAAGATG
CAAGGCTTGCTGGAGCGCGTGAACACGGAGATACACTTTGTCACCAAATG
TGCCTTTCAGCCCCCCCCCAGCTGTCTTCGCTTCGTCCAGACCAACATCT
CCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGA
CTCCTCAACCCTGGGCGGTGGATCCGGAGGTGGCACCCAGGACTGCTCCT
TCCAACACAGCCCCATCTCCTCCGACTTCGCTGTCAAAATCCGTGAGCTG
TCTGACTACCTGCTTCAAGATTACCCAGTCACCGTGGCCTCCAACCTGCA
GGACGAGGAGCTCTGCGGGGCCTCTGGCGGCTGGTCCTGGCACAGCGCT
GGATGGAGCGGCTCAAGACTGTCGCTGGG SEQ ID NO:150
pMON32380.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCTCCAAGATG
CAAGGCTTGCTGGAGCGCGTGAACACGGAGATACACTTTGTCACCAAATG
TGCCTTTCAGCCCCCCCCCAGCTGTCTTCGCTTCGTCCAGACCAACATCT
CCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGA
CTCCTCAACCCTGGGCGGTGGGTCAGGAGGTGGATCCGGAGGTACCCAGG
ACTGCTCCTTCCAACACAGCCCCATCTCCTCCGACTTCGCTGTCAAAATC
CGTGAGCTGTCTGACTACCTGCTTCAAGATTACCCAGTCACCGTGGCCTC TABLE 2-continued

| GENE SEQUENCES |
|---|

CAACCTGCAGGACGAGGAGCTCTGCGGGGGCCTCTGGCGGCTGGTCCTGG
CACAGCGCTGGATGGAGCGGCTCAAGACTGTCGCTGGG
SEQ ID NO:151
pMON32381.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGqTCCCCGGGTGAACCGTCTGGTCCAATCTCTACTATCAACCCGT
CTCCTCCGTCTAAAGAATCTCATAAATCTCCAAACATGGCCTCCAAGATG
CAAGGCTTGCTGGAGCGCGTGAACACGGAGATACACTTTGTCACCAAATG
TGCCTTTCAGCCCCCCCCAGCTGTCTTCGCTTCGTCCAGACCAACATCT
CCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGA
CTCCTCAACCCTGGGCGGTGGATCCGAGGTGGCTCAGGGGGAGGTAGTG
GTACCCAGGACTGCTCCTTCCAACACAGCCCCATCTCCTCCGACTTCGCT
GTCAAAATCCGTGAGCTGTCTGACTACCTGCTTCAAGATTACCCAGTCAC
CGTGGCCTCCAACCTGCAGGACGAGGAGCTCTGCGGGGCCTCTGGCGGC
TGGTCCTGGCACAGCGCTGGATGGAGCGGCTCAAGACTGTCGCTGGG
SEQ ID NO:152
pMON32382.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCTCCAAGATG
CAAGGCTTGCTGGAGCGCGTGAACACGGAGATACACTTTGTCACCAAATG
TGCCTTTCAGCCCCCCCCAGCTGTCTTCGCTTCGTCCAGACCAACATCT
CCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGA
CTCCTCAACCCTGGGCGGTGGGTCAGGAGGTGGGTCAGGAGGTGGATCCG
GAGGTGGCACCCAGGACTGCTCCTTCCAACACAGCCCCATCTCCTCCGAC
TTCGCTGTCAAAATCCGTGAGCTGTCTGACTACCTGCTTCAAGATTACCC
AGTCACCGTGGCCTCCAACCTGCAGGACGAGGAGCTCTGCGGGGCCTCT
GGCGGCTGGTCCTGGCACAGCGCTGGATGGAGCGGCTCAAGACTGTCGCT
GGG SEQ ID NO:153
pMON32383.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCTCCAAGATG
CAAGGCTTGCTGGAGCGCGTGAACACGGAGATACACTTTGTCACCAAATG
TGCCTTTCAGCCCCCCCCAGCTGTCTTCGCTTCGTCCAGACCAACATCT
CCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGA
CTCCTCAACCCTGGGCGGTGGGTCAGGAGGTGGGTCAGGAGGTGGATCCG
GAGGTGGCTCAGGGGGAGGTAGTGGTACCCAGGACTGCTCCTTCCAACAC
AGCCCCATCTCCTCCGACTTCGCTGTCAAAATCCGTGAGCTGTCTGACTA
CCTGCTTCAAGATTACCCAGTCACCGTGGCCTCCAACCTGCAGGACGAGG
AGCTCTGCGGGGCCTCTGGCGGCTGGTCCTGGCACAGCGCTGGATGGAG
CGGCTCAAGACTGTCGCTGGG SEQ ID NO:154
pMON32384.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCCCCCCAGC

TABLE 2-continued

GENE SEQUENCES

```
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGGGCGGTGGA
TCCGGAGGTACCCAGGACTGCTCCTTCCAACACAGCCCCATCTCCTCCGA
CTTCGCTGTCAAAATCCGTGAGCTGTCTGACTACCTGCTTCAAGATTACC
CAGTCACCGTGGCCTCCAACCTGCAGGACGAGGAGCTCTGCGGGGCCTC
TGGCGGCTGGTCCTGGCACAGCGCTGGATGGAGCGGCTCAAGACTGTCGC
TGGGTCCAAGATGCAAGGCTTGCTGGAGCGCGTGAACACGGAGATACACT
TTGTCACCAAATGTGCCTTTCAGCCC SEQ ID NO:155
pMON32385.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGGGCGGTGGA
TCCGGAGGTGGCACCCAGGACTGCTCCTTCCAACACAGCCCCATCTCCTC
CGACTTCGCTGTCAAAATCCGTGAGCTGTCTGACTACCTGCTTCAAGATT
ACCCAGTCACCGTGGCCTCCAACCTGCAGGATGAGGAGCTCTGCGGGGGC
CTCTGGCGGCTGGTCCTGGCACAGCGCTGGATGGAGCGGCTCAAGACTGT
CGCTGGGTCCAAGATGCAAGGCTTGCTGGAGCGCGTGAACACGGAGATAC
ACTTTGTCACCAAATGTGCCTTTCAGCCC SEQ ID NO:156
pMON32386.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGGGCGGTGGG
TCAGGAGGTGGATCCGGAGGTACCCAGGACTGCTCCTTCCAACACAGCCC
CATCTCCTCCGACTTCGCTGTCAAAATCCGTGAGCTGTCTGACTACCTGC
TTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCT
CAAGACTGTCGCTGGGTCCAAGATGCAAGGCTTGCTGGAGCGCGTGAACA
CGGAGATACACTTTGTCACCAAATGTGCCTTTCAGCCC
SEQ ID NO:157
pMON32387.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGGGCGGTGGA
TCCGGAGGTGGCTCAGGGGAGGTAGTGGTACCCAGGACTGCTCCTTCCA
ACACAGCCCCATCTCCTCCGACTTCGCTGTCAAAATCCGTGAGCTGTCTG
ACTACCTGCTTCAAGATTACCCAGTCACCGTGGCCTCCAACCTGCAGGAC
GAGGAGCTCTGCGGGGGCCTCTGGCGGCTGGTCCTGGCACAGCGCTGGAT
GGAGCGGCTCAAGACTGTCGCTGGGTCCAAGATGCAAGGCTTGCTGGAGC
GCGTGAACACGGAGATACACTTTGTCACCAAATGTGCCTTTCAGCCC
SEQ ID NO:158
pMON32388.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
```

TABLE 2-continued

GENE SEQUENCES

TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGGGCGGTGGG
TCAGGAGGTGGGTCAGGAGGTGGATCCGGAGGTGGCACCCAGGACTGCTC
CTTCCAACACAGCCCCATCTCCTCCGACTTCGCTGTCAAAATCCGTGAGC
TGTCTGACTACCTGCTTCAAGATTACCCAGTCACCGTGGCCTCCAACCTG
CAGGACGAGGAGCTCTGCGGGGGCCTCTGGCGGCTGGTCCTGGCACAGCG
CTGGATGGAGCGGCTCAAGACTGTCGCTGGGTCCAAGATGCAAGGCTTGC
TGGAGCGCGTGAACACGGAGATACACTTTGTCACCAAATGTGCCTTTCAG
CCC SEQ ID NO:159
pMON32389.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCCCCCCAGC
TGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCC
GGTGCCTGGAGCTGCAGTGTCAGCCCGACTCCTCAACCCTGGGCGGTGGG
TCAGGAGGTGGGTCAGGAGGTGGATCCGGAGGTGGCTCAGGGGAGGTAG
TGGTACCCAGGACTGCTCCTTCCAACACAGCCCCATCTCCTCCGACTTCG
CTGTCAAAATCCGTGAGCTGTCTGACTACCTGCTTCAAGATTACCCAGTC
ACCGTGGCCTCCAACCTGCAGGACGAGGAGCTCTGCGGGGGCCTCTGGCG
GCTGGTCCTGGCACAGCGCTGGATGGAGCGGCTCAAGACTGTCGCTGGGT
CCAAGATGCAAGGCTTGCTGGAGCGCGTGAACACGGAGATACACTTTGTC
ACCAAATGTGCCTTTCAGCCC SEQ ID NO:160
hflt3-2829link10.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGATTACCCA
GTCACCGTGGCCTCCAACCTGCAGGACGAGGAGCTCTGCGGGGGCCTCTG
GCGGCTGGTCCTGGCACAGCGCTGGATGGAGCGGCTCAAGACTGTCGCTG
GGTCCAAGATGCAAGGCTTGCTGGAGCGCGTGAACACGGAGATACACTTT
GTCACCAAATGTGCCTTTCAGCCCCCCCCCAGCTGTCTTCGCTTCGTCCA
GACCAACATCTCCCGCCTCCTGCAGGAGACCTCCGAGCAGCTGGTGGCGC
TGAAGCCCTGGATCACTCGCCAGAACTTCTCCCGGTGCCTGGAGCTGCAG
TGTCAGCCCGACTCCTCAACCCTGGGCGGTGGGTCAGGAGGTGGATCCGG
AGGTACCCAGGACTGCTCCTTCCAACACAGCCCCATCTCCTCCGACTTCG
CTGTCAAAATCCGTGAGCTGTCTGACTACCTGCTTCAA
SEQ ID NO:161
hflt3-2829link15.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGATTACCCA
GTCACCGTGGCCTCCAACCTGCAGGACGAGGAGCTCTGCGGGGGCCTCTG
GCGGCTGGTCCTGGCACAGCGCTGGATGGAGCGGCTCAAGACTGTCGCTG
GGTCCAAGATGCAAGGCTTGCTGGAGCGCGTGAACACGGAGATACACTTT
GTCACCAAATGTGCCTTTCAGCCCCCCCCCAGCTGTCTTCGCTTCGTCCA
GACCAACATCTCCCGCCTCCTGCAGGAGACCTCCGAGCAGCTGGTGGCGC
TGAAGCCCTGGATCACTCGCCAGAACTTCTCCCGGTGCCTGGAGCTGCAG
TGTCAGCCCGACTCCTCAACCCTGGGCGGTGGGTCAGGAGGTGGGTCAGG
AGGTGGATCCGGAGGTGGCACCCAGGACTGCTCCTTCCAACACAGCCCCA TABLE 2-continued

GENE SEQUENCES

TCTCCTCCGACTTCGCTGTCAAAATCCGTGAGCTGTCTGACTACCTGCTT
CAA SEQ ID NO:162
hflt3-3435link10.seq GCTAACTGCTCTATAATGATCGATGAAATTATACATCACTTAAAGAGACC
ACCTAACCCTTTGCTGGACCCGAACAACCTCAATTCTGAAGACATGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGCCTCCAAC
CTGCAGGACGAGGAGCTCTGCGGGGGCCTCTGGCGGCTGGTCCTGGCACA
GCGCTGGATGGAGCGGCTCAAGACTGTCGCTGGGTCCAAGATGCAAGGCT
TGCTGGAGCGCGTGAACACGGAGATACACTTTGTCACCAAATGTGCCTTT
CAGCCCCCCCCAGCTGTCTTCGCTTCGTCCAGACCAACATCTCCCGCCT
CCTGCAGGAGACCTCCGAGCAGCTGGTGGCGCTGAAGCCCTGGATCACTC
GCCAGAACTTCTCCCGGTGCCTGGAGCTGCAGTGTCAGCCCGACTCCTCA
ACCCTGGGCGGTGGGTCAGGAGGTGGATCCGGAGGTACCCAGGACTGCTC
CTTCCAACACAGCCCCATCTCCTCCGACTTCGCTGTCAAAATCCGTGAGC
TGTCTGACTACCTGCTTCAAGATTACCCAGTCACCGTG
SEQ ID NO:163
hflt3-3435link15.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAAGGCGG
TGGAGGCTCCCCGGGTGAACCGTCTGGTCCAATCTCTACTATCAACCCGT
CTCCTCCGTCTAAAGAATCTCATAAATCTCCAAACATGGCCGCCTCCAAC
CTGCAGGACGAGGAGCTCTGCGGGGGCCTCTGGCGGCTGGTCCTGGCACA
GCGCTGGATGGAGCGGCTCAAGACTGTCGCTGGGTCCAAGATGCAAGGCT
TGCTGGAGCGCGTGAACACGGAGATACACTTTGTCACCAAATGTGCCTTT
CAGCCCCCCCCAGCTGTCTTCGCTTCGTCCAGACCAACATCTCCCGCCT
CCTGCAGGAGACCTCCGAGCAGCTGGTGGCGCTGAAGCCCTGGATCACTC
GCCAGAACTTCTCCCGGTGCCTGGAGCTGCAGTGTCAGCCCGACTCCTCA
ACCCTGGGCGGTGGGTCAGGAGGTGGGTCAGGAGGTGGATCCGGAGGTGG
CACCCAGGACTGCTCCTTCCAACACAGCCCCATCTCCTCCGACTTCGCTG
TCAAAATCCGTGAGCTGTCTGACTACCTGCTTCAAGATTACCCAGTCACC
GTG SEQ ID NO:164
hflt3-6263link10.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGTCGCTGGG
TCCAAGATGCAAGGCTTGCTGGAGCGCGTGAACACGGAGATACACTTTGT
CACCAAATGTGCCTTTCAGCCCCCCCCAGCTGTCTTCGCTTCGTCCAGA
CCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTG
TCAGCCCGACTCCTCAACCCTGGGCGGTGGGTCAGGAGGTGGATCCGGAG
GTACCCAGGACTGCTCCTTCCAACACAGCCCCATCTCCTCCGACTTCGCT
GTCAAAATCCGTGAGCTGTCTGACTACCTGCTTCAAGATTACCCAGTCAC
CGTGGCCTCCAACCTGCAGGACGAGGAGCTCTGCGGGGGCCTCTGGCGGC
TGGTCCTGGCACAGCGCTGGATGGAGCGGCTCAAGACT
SEQ ID NO:165
hflt3-6263link15.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGTCGCTGGG
TCCAAGATGCAAGGCTTGCTGGAGCGCGTGAACACGGAGATACACTTTGT TABLE 2-continued

GENE SEQUENCES

CACCAAATGTGCCTTTCAGCCCCCCCCCAGCTGTCTTCGCTTCGTCCAGA
CCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTG
TCAGCCCGACTCCTCAACCCTGGGCGGTGGGTCAGGAGGTGGGTCAGGAG
GTGGATCCGGAGGTGGCACCCAGGACTGCTCCTTCCAACACAGCCCCATC
TCCTCCGACTTCGCTGTCAAAATCCGTGAGCTGTCTGACTACCTGCTTCA
AGATTACCCAGTCACCGTGGCCTCCAACCTGCAGGACGAGGAGCTCTGCG
GGGGCCTCTGGCGGCTGGTCCTGGCACAGCGCTGGATGGAGCGGCTCAAG
ACT SEQ ID NO:166
hflt3-9495link10.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCGCTTCGTC
CAGACCAACATCTCCCGCCTCCTGCAGGAGACCTCCGAGCAGCTGGTGGC
GCTGAAGCCCTGGATCACTCGCCAGAACTTCTCCCGGTGCCTGGAGCTGC
AGTGTCAGCCCGACTCCTCAACCCTGGGCGGTGGGTCAGGAGGTGGATCC
GGAGGTACCCAGGACTGCTCCTTCCAACACAGCCCCATCTCCTCCGACTT
CGCTGTCAAAATCCGTGAGCTGTCTGACTACCTGCTTCAAGATTACCCAG
TCACCGTGGCCTCCAACCTGCAGGACGAGGAGCTCTGCGGGGGCCTCTGG
CGGCTGGTCCTGGCACAGCGCTGGATGGAGCGGCTCAAGACTGTCGCTGG
GTCCAAGATGCAAGGCTTGCTGGAGCGCGTGAACACGGAGATACACTTTG
TCACCAAATGTGCCTTTCAGCCCCCCCCCAGCTGTCTT
SEQ ID NO:167
hflt3-9495link15.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCGCTTCGTC
CAGACCAACATCTCCCGCCTCCTGCAGGAGACCTCCGAGCAGCTGGTGGC
GCTGAAGCCCTGGATCACTCGCCAGAACTTCTCCCGGTGCCTGGAGCTGC
AGTGTCAGCCCGACTCCTCAACCCTGGGCGGTGGGTCAGGAGGTGGGTCA
GGAGGTGGATCCGGAGGTGGCACCCAGGACTGCTCCTTCCAACACAGCCC
CATCTCCTCCGACTTCGCTGTCAAAATCCGTGAGCTGTCTGACTACCTGC
TTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCT
CAAGACTGTCGCTGGGTCCAAGATGCAAGGCTTGCTGGAGCGCGTGAACA
CGGAGATACACTTTGTCACCAAATGTGCCTTTCAGCCCCCCCCCAGCTGT
CTT SEQ ID NO:168
hflt3-9899link10.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAAGCTCCCCGGGTGAACCGTCTGGTCCAATCTCTACTATCAACCCGT
CTCCTCCGTCTAAAGAATCTCATAAATCTCCAAACATGGCCACCAACATC
TCCCGCCTCCTGCAGGAGACCTCCGAGCAGCTGGTGGCGCTGAAGCCCTG
GATCACTCGCCAGAACTTCTCCCGGTGCCTGGAGCTGCAGTGTCAGCCCG
ACTCCTCAACCCTGGGCGGTGGGTCAGGAGGTGGATCCGGAGGTACCCAG
GACTGCTCCTTCCAACACAGCCCCATCTCCTCCGACTTCGCTGTCAAAAT
CCGTGAGCTGTCTGACTACCTGCTTCAAGATTACCCAGTCACCGTGGCCT
CCAACCTGCAGGACGAGGAGCTCTGCGGGGGCCTCTGGCGGCTGGTCCTG
GCACAGCGCTGGATGGAGCGGCTCAAGACTGTCGCTGGGTCCAAGATGCA
AGGCTTGCTGGAGCGCGTGAACACGGAGATACACTTTGTCACCAAATGTG
CCTTTCAGCCCCCCCCCAGCTGTCTTCGCTTCGTCCAG
SEQ ID NO:169
hflt3-9899link15.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG TABLE 2-continued

GENE SEQUENCES

```
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCACCAACATC
TCCCGCCTCCTGCAGGAGACCTCCGAGCAGCTGGTGGCGCTGAAGCCCTG
GATCACTCGCCAGAACTTCTCCCGGTGCCTGGAGCTGCAGTGTCAGCCCG
ACTCCTCAACCCTGGGCGGTGGGTCAGGAGGTGGGTCAGGAGGTGGATCC
GGAGGTGGCACCCAGGACTGCTCCTTCCAACACAGCCCCATCTCCTCCGA
CTTCGCTGTCAAAATCCGTGAGCTGTCTGACTACCTGCTTCAAGATTACC
CAGTCACCGTGGCCTCCAACCTGCAGGACGAGGAGCTCTGCGGGGGCCTC
TGGCGGCTGGTCCTGGCACAGCGCTGGATGGAGCGGCTCAAGACTGTCGC
TGGGTCCAAGATGCAAGGCTTGCTGGAGCGCGTGAACACGGAGATACACT
TTGTCACCAAATGTGCCTTTCAGCCCCCCCCCAGCTGTCTTCGCTTCGTC
CAG SEQ ID NO:170
hflt3-2829link6.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGATTACCCA
GTCACCGTGGCCTCCAACCTGCAGGACGAGGAGCTCTGCGGGGGCCTCTG
GCGGCTGGTCCTGGCACAGCGCTGGATGGAGCGGCTCAAGACTGTCGCTG
GGTCCAAGATGCAAGGCTTGCTGGAGCGCGTGAACACGGAGATACACTTT
GTCACCAAATGTGCCTTTCAGCCCCCCCCAGCTGTCTTCGCTTCGTCCA
GACCAACATCTCCCGCCTCCTGCAGGAGACCTCCGAGCAGCTGGTGGCGC
TGAAGCCCTGGATCACTCGCCAGAACTTCTCCCGGTGCCTGGAGCTGCAG
TGTCAGCCCGACTCCTCAACCCTGGGCGGTGGATCCGGAGGTACCCAGGA
CTGCTCCTTCCAACACAGCCCCATCTCCTCCGACTTCGCTGTCAAAATCC
GTGAGCTGTCTGACTACCTGCTTCAA SEQ ID NO:171
hflt3-2829link7.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGATTACCCA
GTCACCGTGGCCTCCAACCTGCAGGACGAGGAGCTCTGCGGGGGCCTCTG
GCGGCTGGTCCTGGCACAGCGCTGGATGGAGCGGCTCAAGACTGTCGCTG
GGTCCAAGATGCAAGGCTTGCTGGAGCGCGTGAACACGGAGATACACTTT
GTCACCAAATGTGCCTTTCAGCCCCCCCCAGCTGTCTTCGCTTCGTCCA
GACCAACATCTCCCGCCTCCTGCAGGAGACCTCCGAGCAGCTGGTGGCGC
TGAAGCCCTGGATCACTCGCCAGAACTTCTCCCGGTGCCTGGAGCTGCAG
TGTCAGCCCGACTCCTCAACCCTGGGCGGTGGATCCGGAGGTGGCACCCA
GGACTGCTCCTTCCAACACAGCCCCATCTCCTCCGACTTCGCTGTCAAAA
TCCGTGAGCTGTCTGACTACCTGCTTCAA SEQ ID NO:172
hflt3-2829link13.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGATTACCCA
GTCACCGTGGCCTCCAACCTGCAGGACGAGGAGCTCTGCGGGGGCCTCTG
GCGGCTGGTCCTGGCACAGCGCTGGATGGAGCGGCTCAAGACTGTCGCTG
GGTCCAAGATGCAAGGCTTGCTGGAGCGCGTGAACACGGAGATACACTTT
GTCACCAAATGTGCCTTTCAGCCCCCCCCAGCTGTCTTCGCTTCGTCCA
GACCAACATCTCCCGCCTCCTGCAGGAGACCTCCGAGCAGCTGGTGGCGC
TGAAGCCCTGGATCACTCGCCAGAACTTCTCCCGGTGCCTGGAGCTGCAG
TGTCAGCCCGACTCCTCAACCCTGGGCGGTGGATCCGGAGGTGGCTCAGG
GGGAGGTAGTGGTACCCAGGACTGCTCCTTCCAACACAGCCCCATCTCCT
CCGACTTCGCTGTCAAAATCCGTGAGCTGTCTGACTACCTGCTTCAA
SEQ ID NO:173
```

TABLE 2-continued

GENE SEQUENCES hflt3-2829link21.seq

GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGATTACCCA
GTCACCGTGGCCTCCAACCTGCAGGACGAGGAGCTCTGCGGGGGCCTCTG
GCGGCTGGTCCTGGCACAGCGCTGGATGGAGCGGCTCAAGACTGTCGCTG
GGTCCAAGATGCAAGGCTTGCTGGAGCGCGTGAACACGGAGATACACTTT
GTCACCAAATGTGCCTTTCAGCCCCCCCCCAGCTGTCTTCGCTTCGTCCA
GACCAACATCTCCCGCCTCCTGCAGGAGACCTCCGAGCAGCTGGTGGCGC
TGAAGCCCTGGATCACTCGCCAGAACTTCTCCCGGTGCCTGGAGCTGCAG
TGTCAGCCCGACTCCTCAACCCTGGGCGGTGGGTCAGGAGGTGGGTCAGG
AGGTGGATCCGGAGGTGGCTCAGGGGGAGGTAGTGGTACCCAGGACTGCT
CCTTCCAACACAGCCCCATCTCCTCCGACTTCGCTGTCAAAATCCGTGAG
CTGTCTGACTACCTGCTTCAA SEQ ID NO:174 hflt3-3435link6.seq

GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGCCTCCAAC
CTGCAGGACGAGGAGCTCTGCGGGGGCCTCTGGCGGCTGGTCCTGGCACA
GCGCTGGATGGAGCGGCTCAAGACTGTCGCTGGGTCCAAGATGCAAGGCT
TGCTGGAGCGCGTGAACACGGAGATACACTTTGTCACCAAATGTGCCTTT
CAGCCCCCCCCCAGCTGTCTTCGCTTCGTCCAGACCAACATCTCCCGCCT
CCTGCAGGAGACCTCCGAGCAGCTGGTGGCGCTGAAGCCCTGGATCACTC
GCCAGAACTTCTCCCGGTGCCTGGAGCTGCAGTGTCAGCCCGACTCCTCA
ACCCTGGGCGGTGGATCCGGAGGTACTGCTCCTTCCAACACAGCCCCATC
TCCTCCGACTTCGCTGTCAAAATCCGTGAGCTGTCTGACTACCTGCTTCA
AGATTACCCAGTCACCGTG SEQ ID NO:175 hflt3-3435link7.seq

GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCTCCAAC
CTGCAGGACGAGGAGCTCTGCGGGGGCCTCTGGCGGCTGGTCCTGGCACA
GCGCTGGATGGAGCGGCTCAAGACTGTCGCTGGGTCCAAGATGCAAGGCT
TGCTGGAGCGCGTGAACACGGAGATACACTTTGTCACCAAATGTGCCTTT
CAGCCCCCCCCCAGCTGTCTTCGCTTCGTCCAGACCAACATCTCCCGCCT
CCTGCAGGAGACCTCCGAGCAGCTGGTGGCGCTGAAGCCCTGGATCACTC
GCCAGAACTTCTCCCGGTGCCTGGAGCTGCAGTGTCAGCCCGACTCCTCA
ACCCTGGGCGGTGGATCCGGAGGTGGCACTGCTCCTTCCAACACAGCCCC
ATCTCCTCCGACTTCGCTGTCAAAATCCGTGAGCTGTCTGACTACCTGCT
TCAAGATTACCCAGTCACCGTG SEQ ID NO:176 hflt3-3435link13.seq

GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGCCTCCAAC
CTGCAGGACGAGGAGCTCTGCGGGGGCCTCTGGCGGCTGGTCCTGGCACA
GCGCTGGATGGAGCGGCTCAAGACTGTCGCTGGGTCCAAGATGCAAGGCT
TGCTGGAGCGCGTGAACACGGAGATACACTTTGTCACCAAATGTGCCTTT
CAGCCCCCCCCCAGCTGTCTTCGCTTCGTCCAGACCAACATCTCCCGCCT
CCTGCAGGAGACCTCCGAGCAGCTGGTGGCGCTGAAGCCCTGGATCACTC

TABLE 2-continued

GENE SEQUENCES

GCCAGAACTTCTCCCGGTGCCTGGAGCTGCAGTGTCAGCCCGACTCCTCA
ACCCTGGGCGGTGGATCCGGAGGTGGCTCAGGGGGAGGTAGTGGTACTGC
TCCTTCCAACACAGCCCCATCTCCTCCGACTTCGCTGTCAAAATCCGTGA
GCTGTCTGACTACCTGCTTCAAGATTACCCAGTCACCGTG
SEQ ID NO:177
hflt3-3435link21.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGCCTCCAAC
CTGCAGGACGAGGAGCTCTGCGGGGGCCTCTGGCGGCTGGTCCTGGCACA
GCGCTGGATGGAGCGGCTCAAGACTGTCGCTGGGTCCAAGATGCAAGGCT
TGCTGGAGCGCGTGAACACGGAGATACACTTTGTCACCAAATGTGCCTTT
CAGCCCCCCCCAGCTGTCTTCGCTTCGTCCAGACCAACATCTCCCGCCT
CCTGCAGGAGACCTCCGAGCAGCTGGTGGCGCTGAAGCCCTGGATCACTC
GCCAGAACTTCTCCCGGTGCCTGGAGCTGCAGTGTCAGCCCGACTCCTCA
ACCCTGGGCGGTGGGTCAGGAGGTGGGTCAGGAGGTGGATCCGGAGGTGG
CTCAGGGGGAGGTAGTGGTAGGACTGCTCCTTCCAACACAGCCCCATCTC
CTCCGACTTCGCTGTCAAAATCCGTGAGCTGTCTGACTACCTGCTTCAAG
ATTACCCAGTCACCGTG SEQ ID NO:178
hflt3-6263link6.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGTCGCTGGG
TCCAAGATGCAAGGCTTGCTGGAGCGCGTGAACACGGAGATACACTTTGT
CACCAAATGTGCCTTTCAGCCCCCCCCAGCTGTCTTCGCTTCGTCCAGA
CCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTG
TCAGCCCGACTCCTCAACCCTGGGCGGTGGATCCGGAGGTACCCAGGACT
GCTCCTTCCAACACAGCCCCATCTCCTCCGACTTCGCTGTCAAAATCCGT
GAGCTGTCTGACTACCTGCTTCAAGATTACCCAGTCACCGTGGCCTCCAA
CCTGCAGGACGAGGAGCTCTGCGGGGGCCTCTGGCGGCTGGTCCTGGCAC
AGCGCTGGATGGAGCGGCTCAAGACT SEQ ID NO:179
hflt3-6263link7.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGTCGCTGGG
TCCAAGATGCAAGGCTTGCTGGAGCGCGTGAACACGGAGATACACTTTGT
CACCAAATGTGCCTTTCAGCCCCCCCCAGCTGTCTTCGCTTCGTCCAGA
CCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTG
TCAGCCCGACTCCTCAACCCTGGGCGGTGGATCCGGAGGTGGCACCCAGG
ACTGCTCCTTCCAACACAGCCCCATCTCCTCCGACTTCGCTGTCAAAATC
CGTGAGCTGTCTGACTACCTGCTTCAAGATTACCCAGTCACCGTGGCCTC
CAACCTGCAGGACGAGGAGCTCTGCGGGGCCTCTGGCGGCTGGTCCTGG
CACAGCGCTGGATGGAGCGGCTCAAGACT SEQ ID NO:180
hflt3-6263link13.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGTCGCTGGG

TABLE 2-continued

GENE SEQUENCES

TCCAAGATGCAAGGCTTGCTGGAGCGCGTGAACACGGAGATACACTTTGT
CACCAAATGTGCCTTTCAGCCCCCCCCCAGCTGTCTTCGCTTCGTCCAGA
CCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTG
TCAGCCCGACTCCTCAACCCTGGGCGGTGGATCCGGAGGTGGCTCAGGGG
GAGGTAGTGGTACCCAGGACTGCTCCTTCCAACACAGCCCCATCTCCTCC
GACTTCGCTGTCAAAATCCGTGAGCTGTCTGACTACCTGCTTCAAGATTA
CCCAGTCACCGTGGCCTCCAACCTGCAGGACGAGGAGCTCTGCGGGGGCC
TCTGGCGGCTGGTCCTGGCACAGCGCTGGATGGAGCGGCTCAAGACT
SEQ ID NO:181
hflt3-6263link21.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCGTCGCTGGG
TCCAAGATGCAAGGCTTGCTGGAGCGCGTGAACACGGAGATACACTTTGT
CACCAAATGTGCCTTTCAGCCCCCCCCCAGCTGTCTTCGCTTCGTCCAGA
CCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTG
TCAGCCCGACTCCTCAACCCTGGGCGGTGGGTCAGGAGGTGGGTCAGGAG
GTGGATCCGGAGGTGGCTCAGGGGGAGGTAGTGGTACCCAGGACTGCTCC
TTCCAACACAGCCCCATCTCCTCCGACTTCGCTGTCAAAATCCGTGAGCT
GTCTGACTACCTGCTTCAAGATTACCCAGTCACCGTGGCCTCCAACCTGC
AGGACGAGGAGCTCTGCGGGGGCCTCTGGCGGCTGGTCCTGGCACAGCGC
TGGATGGAGCGGCTCAAGACT SEQ ID NO:182
hflt3-9495link6.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCGCTTCGTC
CAGACCAACATCTCCCGCCTCCTGCAGGAGACCTCCGAGCAGCTGGTGGC
GCTGAAGCCCTGGATCACTCGCCAGAACTTCTCCCGGTGCCTGGAGCTGC
AGTGTCAGCCCGACTCCTCAACCCTGGGCGGTGGATCCGGAGGTACCCAG
GACTGCTCCTTCCAACACAGCCCCATCTCCTCCGACTTCGCTGTCAAAAT
CCGTGAGCTGTCTGACTACCTGCTTCAAGATTACCCAGTCACCGTGGCCT
CCAACCTGCAGGACGAGGAGCTCTGCGGGGGCCTCTGGCGGCTGGTCCTG
GCACAGCGCTGGATGGAGCGGCTCAAGACTGTCGCTGGGTCCAAGATGCA
AGGCTTGCTGGAGCGCGTGAACACGGAGATACACTTTGTCACCAAATGTG
CCTTTCAGCCCCCCCCCAGCTGTCTT SEQ ID NO:183
hflt3-9495link7.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGCTCCAATCTCTACTATCAACCCGT
CTCCTCCGTCTAAAGAATCTCATAAATCTCCAAACATGGCCCGCTTCGTC
CAGACCAACATCTCCCGCCTCCTGCAGGAGACCTCCGAGCAGCTGGTGGC
GCTGAAGCCCTGGATCACTCGCCAGAACTTCTCCCGGTGCCTGGAGCTGC
AGTGTCAGCCCGACTCCTCAACCCTGGGCGGTGGATCCGGAGGTGGCACC
CAGGACTGCTCCTTCCAACACAGCCCCATCTCCTCCGACTTCGCTGTCAA
AATCCGTGAGCTGTCTGACTACCTGCTTCAAGATTACCCAGTCACCGTGG
CCTCCAACCTGCAGGACGAGGAGCTCTGCGGGGGCCTCTGGCGGCTGGTC
CTGGCACAGCGCTGGATGGAGCGGCTCAAGACTGTCGCTGGGTCCAAGAT
GCAAGGCTTGCTGGAGCGCGTGAACACGGAGATACACTTTGTCACCAAAT
GTGCCTTTCAGCCCCCCCCCAGCTGTCTT SEQ ID NO:184
hflt3-9495link13.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGC
GCTGTCAAGCACTTAGAAAATGCATCAGGTATTGAGGCAATTCTTCGTAA TABLE 2-continued

GENE SEQUENCES

TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCGCTTCGTC
CAGACCAACATCTCCCGCCTCCTGCAGGAGACCTCCGAGCAGCTGGTGGC
GCTGAAGCCCTGGATCACTCGCCAGAACTTCTCCCGGTGCCTGGAGCTGC
AGTGTCAGCCCGACTCCTCAACCCTGGGCGGTGGATCCGGAGGTGGCTCA
GGGGGAGGTAGTGGTACCCAGGACTGCTCCTTCCAACACAGCCCCATCTC
CTCCGACTTCGCTGTCAAAATCCGTGAGCTGTCTGACTACCTGCTTCAAG
ATTACCCAGTCACCGTGGCCTCCAACCTGCAGGACCAGGAGCTCTGCGGG
GGCCTCTGGCGGCTGGTCCTGGCACAGCGCTGGATGGAGCGGCTCAAGAC
TGTCGCTGGGTCCAAGATGCAAGGCTTGCTGGAGCGCGTGAACACGGAGA
TACACTTTGTCACCAAATGTGCCTTTCAGCCCCCCCCCAGCTGTCTT
SEQ ID NO:185
hflt3-9495link21.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCCGCTTCGTC
CAGACCAACATCTCCCGCCTCCTGCAGGAGACCTCCGAGCAGCTGGTGGC
GCTGAAGCCCTGGATCACTCGCCACAACTTCTCCCGGTGCCTGGAGCTGC
AGTCTCAGCCCGACTCCTCAACCCTGGGCGGTGGGTCAGGAGGTGGGTCA
GGAGGTGGATCCGGAGGTGGCTCAGGGGGAGGTAGTGGTACCCAGGACTC
CTCCTTCCAACACAGCCCCATCTCCTCCGACTTCGCTGTCAAAATCCGTG
AGCTGTCTGACTACCTGCTTCAAGATTACCCAGTCACCGTGGCCTCCAAC
CTGCAGGACGAGGAGCTCTGCGGGGGCCTCTGCCGGCTGGTCCTGGCACA
GCGCTGGATGGAGCGGCTCAAGACTGTCGCTGGGTCCAAGATGCAAGGCT
TGCTGGAGCGCGTGAACACGGAGATACACTTTGTCACCAAATGTGCCTTT
CAGCCCCCCCCCAGCTGTCTT SEQ ID NO:186
hflt3-9899link6.seq CCTAACTGCTCTATAATGATCGATGAAATTATACATCACTTAAAGAGACC
ACCTAACCCTTTGCTGGACCCGAACAACCTCAATTCTGAAGACATGCATA
TCCTCATGGAACCAAACCTTCGAACTCCAAACCTGCTCGCATTCGTAAGG
CCTGTCAAGCACTTAGAAAATGCATCAGGTATTGAGGCAATTCTTCCTAA
TCTCCAACCATGTCTGCCCTCTGCCACGGCCGCACCCTCTCGACATCCAA
TCATCATCAAGGCAGGTGACTGGCAAGAATTCCGGGAAAAACTGACCTTC
TATCTGGTTACCCTTGAGCAAGCGCAGGAACAACAGTACGTAGAGGCCGG
TGGAAGCTCCCCGCGTGAACCGTCTGGTCCAATCTCTACTATCAACCCGT
CTCCTCCGTCTAAAGAATCTCATAAATCTCCAAACATGGCCAACAACATC
TCCCGCCTCCTGCAGGAGACCTCCGAGCAGCTGGTGGCGCTGAAGCCCTG
GATCACTCGCCAGAACTTCTCCCGGTGCCTGGAGCTGCAGTGTCAGCCCG
ACTCCTCAACCCTGGGCGGTGGATCCGGAGGTACCCAGGACTGCTCCTTC
CAACACAGCCCCATCTCCTCCGACTTCGCTGTCAAAATCCGTGAGCTGTC
TGACTACCTGCTTCAAGATTACCCAGTCACCGTGGCCTCCAACCTGCAGG
ACGAGGAGCTCTGCGGGGGCCTCTGGCGGCTGGTCCTGGCACAGCGCTGG
ATGGAGCGGCTCAAGACTGTCGCTGGGTCCAAGATGCAAGGCTTGCTGGA
GCGCGTGAACACGGAGATACACTTTGTCACCAAATGTGCCTTTCAGCCCC
CCCCAGCTGTCTTCGCTTCGTCCAG SEQ ID NO:187
hflt3-9899link7.seq GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAAGCTCCCCGGGTGAACCGTCTGGTCCAATCTCTACTATCAACCCGT
CTCCTCCGTCTAAAGAATCTCATAAATCTCCAAACATGGCCACCAACATC
TCCCGCCTCCTGCAGGAGACCTCCGAGCAGCTGGTGGCGCTGAAGCCCTG
GATCACTCGCCAGAACTTCTCCCGGTGCCTGGAGCTGCAGTGTCAGCCCG
ACTCCTCAACCCTGGGCGGTGGATCCGGAGGTGGCACCCAGGACTGCTCC
TTCCAACACAGCCCCATCTCCTCCGACTTCGCTGTCAAAATCCGTGAGCT
GTCTGACTACCTGCTTCAAGATTACCCAGTCACCGTGGCCTCCAACCTGC
AGGACGAGGAGCTCTGCGGGGGCCTCTGGCGGCTGGTCCTGGCACAGCGC
TGGATGGAGCGGCTCAAGACTGTCGCTGGGTCCAAGATGCAAGGCTTGCT
GGAGCGCGTGAACACGGAGATACACTTTGTCACCAAATGTGCCTTTCAGC
CCCCCCCCAGCTGTCTTCGCTTCGTCCAG SEQ ID NO:188

TABLE 2-continued

GENE SEQUENCES hflt3-9899link13.seq

GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAAGCTCCCCGGGTGAACCGTCTGGTCCAATCTCTACTATCAACCCGT
CTCCTCCGTCTAAAGAATCTCATAAATCTCCAAACATGGCCACCAACATC
TCCCGCCTCCTGCAGGAGACCTCCGAGCAGCTGGTGGCGCTGAAGCCCTG
GATCACTCGCCAGAACTTCTCCCGGTGCCTGGAGCTGCAGTGTCAGCCCG
ACTCCTCAACCCTGGGCGGTGGATCCGGAGGTGGCTCAGGGGGAGGTAGT
GGTACCCAGGACTGCTCCTTCCAACACAGCCCCATCTCCTCCGACTTCGC
TGTCAAAATCCGTGAGCTGTCTGACTACCTGCTTCAAGATTACCCAGTCA
CCGTGGCCTCCAACCTGCAGGACGAGGAGCTCTGCGGGGCCTCTGGCGG
CTGGTCCTGGCACAGCGCTGGATGGAGCGGCTCAAGACTGTCGCTGGGTC
CAAGATGCAAGGCTTGCTGGAGCGCGTGAACACGGAGATACACTTTGTCA
CCAAATGTGCCTTTCAGCCCCCCCCCAGCTGTCTTCGCTTCGTCCAG
SEQ ID NO:189 hflt3-9899link21.seq

GCTAACTGCTCTATAATGATCGATGAAATTATACATCACTTAAAGAGACC
ACCTAACCCTTTGCTGGACCCGAACAACCTCAATTCTGAAGACATGGATA
TCCTGATGGAACGAAACCTTCGAACTCCAAACCTGCTCGCATTCGTAAGG
GCTGTCAAGCACTTAGAAAATGCATCAGGTATTGAGGCAATTCTTCGTAA
TCTCCAACCATGTCTGCCCTCTGCCACGGCCGCACCCTCTCGACATCCAA
TCATCATCAAGGCAGGTGACTGGCAAGAATTCCGGGAAAAACTGACGTTC
TATCTGGTTACCCTTGAGCAAGCGCAGGAACAACAGTACGTAGAGGGCGG
TGGAGGCTCCCCGGGTGAACCGTCTGGTCCAATCTCTACTATCAACCCGT
CTCCTCCGTCTAAAGAATCTCATAAATCTCCAAACATGGCCACCAACATC
TCCCGCCTCCTGCAGGAGACCTCCGAGCAGCTGGTGGCGCTGAAGCCCTG
GATCACTCGCCAGAACTTCTCCCGGTGCCTGGAGCTGCAGTGTCAGCCCG
ACTCCTCAACCCTGGGCGGTGGGTCAGGAGGTGGGTCAGGAGGTGGATCC
GGAGGTGGCTCAGGGGGAGGTAGTGGTACCCAGGACTGCTCCTTCCAACA
CAGCCCCATCTCCTCCGACTTCGCTGTCAAAATCCGTGAGCTGTCTGACT
ACCTGCTTCAAGATTACCCAGTCACCGTGGCCTCCAACCTGCAGGACGAG
GAGCTCTGCGGGGCCTCTGGCGGCTGGTCCTGGCACAGCGCTGGATGGA
GCGGCTCAAGACTGTCGCTGGGTCCAAGATGCAAGGCTTGCTGGAGCGCG
TGAACACGGAGATACACTTTGTCACCAAATGTGCCTTTCAGCCCCCCCCC
AGCTGTCTTCGCTTCGTCCAG SEQ ID NO:190 pMON32390

GGATCCACCATGAGCCGCCTGCCCGTCCTGCTCCTGCTCCAACTCCTGGT
CCGCCCCGCCATGTCTACAAATCAAGATCTGCCTGTGATCAAGTGTGTTT
TAATCAATCATAAGAACAATGATTCATCAGTGGGGAAGTCATCATCATAT
CCCATGGTATCAGAATCCCCGGAAGACCTCGGGTGTGCGTTGAGACCCCA
GAGCTCAGGGACAGTGTACGAAGCTGCCGCTGTGGAAGTGGATGTATCTG
CTTCCATCACACTGCAAGTGCTGGTCGATGCCCCAGGGAACATTTCCTGT
CTCTGGGTCTTTAAGCACAGCTCCCTGAATTGCCAGCCACATTTTGATTT
ACAAAACAGAGGAGTTGTTTCCATGGTCATTTTGAAAATGACAGAAACCC
AAGCTGGAGAATACCTACTTTTTATTCAGAGTGAAGCTACCAATTACACA
ATATTGTTTACAGTGAGTATAAGAAATACCCTGCTTTACACATTAAGAAG
ACCTTACTTTAGAAAAATGGAAAACCAGGACGCCCTGGTCTGCATATCTG
AGAGCGTTCCAGAGCCGATCGTGGAATGGGTGCTTTGCGATTCACAGGGG
GAAAGCTGTAAAGAAGAAAGTCCAGCTGTTGTTAAAAAGGAGGAAAAAGT
GCTTCATGAATTATTTGGGATGGACATAAGGTGCTGTGCCAGAAATGAAC
TGGGCAGGGAATGCACCAGGCTGTTCACAATAGATCTAAATCAAACTCCT
CAGACCACATTGCCACAATTATTTCTTAAAGTAGGGGAACCCTTATGGAT
AAGGTGCAAAGCTGTTCATGTGAACCATGGATTCGGGCTCACCTGGGAAT
TAGAAAACAAAGCACTCGAGGAGGCAACTACTTTGAGATGAGTACCTAT
TCAACAAACAGAACTATGATACGGATTCTGTTTGCTTTTGTATCATCAGT
GGCAAGAAACGACACCGGATACTACACTTGTTCCTCTTCAAAGCATCCCA
GTCAATCAGCTTTGGTTACCATCGTAGAAAAGGGATTTATAAATGCTACC
AATTCAAGTGAAGATTATGAAATTGACCAATATGAAGAGTTTTGTTTTTC
TGTCAGGTTTAAAGCCTACCCACAAATCAGATGTACGTGGACCTTCTCTC
GAAAATCATTTCCTTGTGAGCAAAAGGGTCTTGATAACGGATACAGCATA
TCCAAGTTTTGCAATCATAAGCACCAGCCAGGAGAATATATATTCCATGC
AGAAAATGATGATGCCCAATTTACCAAAATGTTCACGCTGAATATAAGAA
GGAAACCTCAAGTGCTCGCAGAAGCATCGGCAAGTCAGGCGTCCTGTTTC
TCGGATGGATATACCCATTACCATCTTGGACCTGGAAGAAGTGTTCAGACAA
GTCTCCCAACTGCACAGAAGAGATCACAGAAGGAGTCTGGAATAGAAAGG
CTAACAGAAAGTGTTTGGACAGTGGGTGTCGAGCAGTACTCTAAACATG
AGTGAAGCCATAAAAGGGTTCCTGGTCAAGTGCTGTGCATACAATTCCCT
TGGCACATCTTGTGAGACGATCCTTTTAAACTCTCCAGGCCCCTTCCCTT
TCATCCAAGACAACGAATTCATCATCCTGGGCCTGTTCGGCCTCCTGCTG

TABLE 2-continued

GENE SEQUENCES

TTGCTCACCTGCCTCTGTGGAACTGCCTGGCTCTGTTGCAGCCCCAACAG
GAAGAATCCCCTCTGGCCAAGTGTCCCAGACCCAGCTCACAGCAGCCTGG
GCTCCTGGGTGCCCACAATCATGGAGGAGGATGCCTTCCAGCTGCCCGGC
CTTGGCACGCCACCCATCACCAAGCTCACAGTGCTGGAGGAGGATGAAAA
GAAGCCGGTGCCCTGGGAGTCCCATAACAGCTCAGAGACCTGTGGCCTCC
CCACTCTGGTCCAGACCTATGTGCTCCAGGGGACCCAAGAGCAGTTTCC
ACCCAGCCCCAATCCCAGTCTGGCACCAGCGATCAGGTCCTTTATGGGCA
GCTGCTGGGCAGCCCCACAAGCCCAGGGCCAGGGCACTATCTCCGCTGTG
ACTCCACTCAGCCCCTCTTGGCGGGCCTCACCCCCAGCCCCAAGTCCTAT
GAGAACCTCTGGTTCCAGGCCAGCCCCTTGGGGACCCTGGTAACCCCAGC
CCCAAGCCAGGAGGACGACTGTGTCTTTGGGCCACTGCTCAACTTCCCCC
TCCTGCAGGGGATCCGGGTCCATGGGATGGAGGCGCTGGGGAGCTTC
SEQ ID NO:191
pMON30329.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCCACCCAGGACTGCTCCTTCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGGACGAGGAGCTCTGCGGGGGCCTCTGGCGGCTGGTCCTGGCACAG
CGCTGGATGGAGCGGCTCAAGACTGTCGCTGGGTCCAAGATGCAAGGCTTGCTGGAGCGCGTGAAC
ACGGAGATACACTTTGTCACCAAATGTGCCTTTCAGCCCCCCCCAGCTGTCTTCGCTTCGTCCAG
ACCAACATCTCCCGCCTCCTGCAGGAGACCTCCGAGCAGCTGGTGGCGCTGAAGCCCTGGATCACT
CGCCAGAACTTCTCCCGGTGCCTGGAGCTGCAGTGTCAGCCCGACTCCTCAACCCTG SEQ ID
NO:192
pMON32173.seq GCCACTCAGGACTGCTCTTTTCAACACAGCCCCATCTCCTCCGACTTCGCTGTCAAAATCCGTGAG
CTGTCTGACTACCTGCTTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCTCAAGACTGTCGCTGGG
TCCAAGATGCAAGGCTTGCTGGAGCGCGTGAACACGGAGATACACTTTGTCACCAAATGTGCCTTT
CAGCCCCCCCCCAGCTGTCTTCGCTTCGTCCAGACCAACATCTCCCGCCTCCTGCAGGAGACCTCC
GAGCAGCTGGTGGCGCTGAAGCCCTGGATCACTCGCCAGAACTTCTCCCGGTGCCTGGAGCTGCAG
TGTCAGCCCGACTCCTCAACCCTGTACGTAGAGGGCGGTGGAGGCTCCCGGGTGAACCGTCTGGT
CCAATCTCTACTATCAACCCGTCTCCTCCGTCTAAAGAATCTCATAAATCTCCAAACATGGCTACC
CAGGACTGCTCCTTCCAACACAGCCCCATCTCCTCCGACTTCGCTGTCAAAATCCGTGAGCTGTCT
GACTACCTGCTTCAAGATTACCCAGTCACCGTGGCCTCCAACCTGCAGGACGAGGAGCTCTGCGGG
GGCCTCTGGCGGCTGGTCCTGGCACAGCGCTGGATGGAGCGGCTCAAGACTGTCGCTGGGTCCAAG
ATGCAAGGCTTGCTGGAGCGCGTGAACACGGAGATACACTTTGTCACCAAATGTGCCTTTCAGCCC
CCCCCAGCTGTCTTCGCTTCGTCCAGACCAACATCTCCCGCCTCCTGCAGGAGACCTCCGAGCAG
CTGGTGGCGCTGAAGCCCTGGATCACTCGCCAGAACTTCTCCCGGTGCCTGGAGCTGCAGTGTCAG
CCCGACTCCTCAACCCTG SEQ ID NO:193
pMON32175.seq GCCACCCAGGACTGCTCCTTTTCAACACAGCCCCATCTCCTCCGACTTCGCTGTCAAAATCCGTGAG
CTGTCTGACTACCTGCTTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCTCAAGACTGTCGCTGGG
TCCAAGATGCAAGGCTTGCTGGAGCGCGTGAACACGGAGATACACTTTGTCACCAAATGTGCCTTT
CAGCCCCCCCCCAGCTGTCTTCGCTTCGTCCAGACCAACATCTCCCGCCTCCTGCAGGAGACCTCC
GAGCAGCTGGTGGCGCTGAAGCCATGGATCACTCGCCAGAACTTCTCCCGGTGCCTGGAGCTGCAG
TGTCAGCCCGACTCCTCAACCCTGTACGTAGAGGGCGGTGGAGGCTCCCGGGTGAACCGTCTGGT
CCAATCTCTACTATCAACCCGTCTCCTCCGTCTAAAGAATCTCATAAATCTCCAAACATGGCTACA
CCATTAGGCCCTGCCAGCTCCCTGCCCCAGAGCTTCCTGCTCAAGTGCTTAGAGCAAGTGAGGAAG
ATCCAGGGCGATGGCGCAGCGCTCCAGGAGAAGCTGTGTGCCACCTACAAGCTGTGCCACCCCGAG
GAGCTGGTGCTGCTCGGACACTCTCTGGGCATCCCCTGGGCTCCCCTGAGCTCCTGCCCCAGCCAG
GCCCTGCAGCTGGCAGGCTGCTTGAGCCAACTCCATAGCGGCCTTTTCCTCTACCAGGGGCTCCTG
CAGGCCCTGGAAGGGATATCCCCCGAGTTGGGTCCCACCTTGGACACACTGCAGCTGGACGTCGCC
GACTTTGCCACCACCATCTGGCAGCAGATGGAAGAACTGGGAATGGCCCCTGCCCTGCAGCCCACC
CAGGGTGCCATGCCGGCCTTCGCCTCTGCTTTCCAGCGCCGGGCAGGAGGGGTCCTGGTTGCTAGC
CATCTGCAGAGCTTCCTGGAGGTGTCGTACCGCGTTTTACGCCACCTTGCGCAGCCC SEQ ID
NO:194
pMON32204.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT

TABLE 2-continued

GENE SEQUENCES

```
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCCACTCAGGACTGCTCTTTTCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGGACGAGGAGCTCTGCGGGGGCCTCTGGCGGCTGGTCCTGGCACAG
CGCTGGATGGAGCGGCTCAAGACTGTCGCTGGGTCCAAGATGCAAGGCTTGCTGGAGCGCGTGAAC
ACGGAGATACACTTTGTCACCAAATGTGCCTTTCAGCCCCCCCCCAGCTGTCTTCGCTTCGTCCAG
ACCAACATCTCCCGCCTCCTGCAGGAGACCTCCGAGCAGCTGGTGGCGCTGAAGCCCTGGATCACT
CGCCAGAACTTCTCCCGGTGCCTGGAGCTGCAGTGTCAGCCCGACTCCTCAACCCTGTACGTAGAG
GGCGGTGGAGGCTCCCCGGGTGAACCGTCTGGTCCAATCTCTACTATCAACCCGTCTCCTCCGTCT
AAAGAATCTCATAAATCTCCAAACATGGCTACCCAGGACTGCTCCTTCCAACACAGCCCCATCTCC
TCCGACTTCGCTGTCAAAATCCGTGAGCTGTCTGACTACCTGCTTCAAGATTACCCAGTCACCGTG
GCCTCCAACCTGCAGGACGAGGAGCTCTGCGGGGCCTCTGGCGGCTGGTCCTGGCACAGCGCTGG
ATGGAGCGGCTCAAGACTGTCGCTGGGTCCAAGATGCAAGGCTTGCTGGAGCGCGTGAACACGGAG
ATACACTTTGTCACCAAATGTGCCTTTCAGCCCCCCCCCAGCTGTCTTCGCTTCGTCCAGACCAAC
ATCTCCCGCCTCCTGCAGGAGACCTCCGAGCAGCTGGTGGCGCTGAAGCCCTGGATCACTCGCCAG
AACTTCTCCCGGTGCCTGGAGCTGCAGTGTCAGCCCGACTCCTCAACCCTG SEQ ID NO:195
pMON32205.seq GCTAACTGCTCTATAATGATCGATGAAATTATACATCACTTAAAGAGACCACCTGCACCTTTGCTG
GACCCGAACAACCTCAATGACGAAGACGTCTCTATCCTGATGGACCGAAACCTTCGACTTCCAAAC
CTGGAGAGCTTCGTAAGGGCTGTCAAGAACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCCACTCAGGACTGCTCTTTTCAA
CACAGCCCCATCTCCTCCGACTTCGCTGTCAAAATCCGTGAGCTGTCTGACTACCTGCTTCAAGAT
TACCCAGTCACCGTGGCCTCCAACCTGCAGGACGAGGAGCTCTGCGGGGCCTCTGGCGGCTGGTC
CTGGCACAGCGCTGGATGGAGCGGCTCAAGACTGTCGCTGGGTCCAAGATGCAAGGCTTGCTGGAG
CGCGTGAACACGGAGATACACTTTGTCACCAAATGTGCCTTTCAGCCCCCCCCCAGCTGTCTTCGC
TTCGTCCAGACCAACATCTCCCGCCTCCTGCAGGAGACCTCCGAGCAGCTGGTGGCGCTGAAGCCC
TGGATCACTCGCCAGAACTTCTCCCGGTGCCTGGAGCTGCAGTGTCAGCCCGACTCCTCAACCCTG
TACGTAGAGGGCGGTGGAGGCTCCCCGGGTGAACCGTCTGGTCCAATCTCTACTATCAACCCGTCT
CCTCCGTCTAAAGAATCTCATAAATCTCCAAACATGGCTACCCAGGACTGCTCCTTCCAACACAGC
CCCATCTCCTCCGACTTCGCTGTCAAAATCCGTGAGCTGTCTGACTACCTGCTTCAAGATTACCCA
GTCACCGTGGCCTCCAACCTGCAGGACGAGGAGCTCTGCGGGGGCCTCTGGCGGCTGGTCCTGGCA
CAGCGCTGGATGGAGCGGCTCAAGACTGTCGCTGGGTCCAAGATGCAAGGCTTGCTGGAGCGCGTG
AACACGGAGATACACTTTGTCACCAAATGTGCCTTTCAGCCCCCCCCCAGCTGTCTTCGCTTCGTC
CAGACCAACATCTCCCGCCTCCTGCAGGAGACCTCCGAGCAGCTGGTGGCGCTGAAGCCCTGGATC
ACTCGCCAGAACTTCTCCCGGTGCCTGGAGCTGCAGTGTCAGCCCGACTCCTCAACCCTG SEQ
ID NO:196
pMON32208.seq GCCACTCAGGACTGCTCTTTTCAACACAGCCCCATCTCCTCCGACTTCGCTGTCAAAATCCGTGAG
CTGTCTGACTACCTGCTTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCTCAAGACTGTCGCTGGG
TCCAAGATGCAAGGCTTGCTGGAGCGCGTGAACACGGAGATACACTTTGTCACCAAATGTGCCTTT
CAGCCCCCCCCCAGCTGTCTTCGCTTCGTCCAGACCAACATCTCCCGCCTCCTGCAGGAGACCTCC
GAGCAGCTGGTGGCGCTGAAGCCCTGGATCACTCGCCAGAACTTCTCCCGGTGCCTGGAGCTGCAG
TGTCAGCCCGACTCCTCAACCCTGTACGTAGAGGGCGGTGGAGGCTCCCCGGGTGAACCGTCTGGT
CCAATCTCTACTATCAACCCGTCTCCTCCGTCTAAAGAATCTCATAAATCTCCAAACATGGCTACA
CCATTGGGCCCTGCCAGCTCCCTGCCCCAGAGCTTCCTGCTCAAGTCTTTTAGAGCAAGTGAGAAAG
ATCCAGGGCGATGGCGCAGCGCTCCAGGAGAAGCTGTGTGCCACCTACAAGCTGTGCCACCCCGAG
GAGCTGGTGCTGCTCGGACACTCTCTGGGCATCCCCTGGGCTCCCCTGAGCTCCTGCCCCAGCCAG
GCCCTGCAGCTGGCAGGCTGCTTGAGCCAACTCCATAGCGGCCTTTTCCTCTACCAGGGGCTCCTG
CAGGCCCTGGAAGGGATATCCCCCGAGTTGGGTCCCACCTTGGCACACACTGCAGCTGGACGTCGCC
GACTTTGCCACCACCATCTGGCAGCAGATGGAAGAACTGGGAATGGCCCCTGCCCTGCAGCCCACC
CAGGGTGCCATGCCGGCCTTCGCCTCTGCTTTCCAGCGCCGGGCAGGAGGGGTCCTGGTTGCTAGC
CATCTGCAGAGCTTCCTGGAGGTGTCGTACCGCGTTCTACGCCACCTTGCGCAGCCCTACGTAGAG
GGCGGTGGAGGCTCCCCGGGTGAACCGTCTGGTCCAATCTCTACTATCAACCCGTCTCCTCCGTCT
AAAGAATCTCATAAATCTCCAAACATGGCTACCCAGGACTGCTCCTTCCAACACAGCCCCATCTCC
TCCGACTTCGCTGTCAAAATCCGTGAGCTGTCTGACTACCTGCTTCAAGATTACCCAGTCACCGTG
GCCTCCAACCTGCAGGACGAGGAGCTCTGCGGGGCCTCTGGCGGCTGGTCCTGGCACAGCGCTGG
ATGGAGCGGCTCAAGACTGTCGCTGGGTCCAAGATGCAAGGCTTGCTGGAGCGCGTGAACACGGAG
ATACACTTTGTCACCAAATGTGCCTTTCAGCCCCCCCCCAGCTGTCTTCGCTTCGTCCAGACCAAC
ATCTCCCGCCTCCTGCAGGAGACCTCCGAGCAGCTGGTGGCGCTGAAGCCCTGGATCACTCGCCAG
AACTTCTCCCGGTGCCTGGAGCTGCAGTGTCAGCCCGACTCCTCAACCCTG SEQ ID NO:197
pMON35767.seq/pMON32191.seq GGCCACTCAGGACTGCTCTTTTCAACACAGCCCCATCTCCTCCGACTTCGCTGTCAAAATCCGTGA
GCTGTCTGACTACCTGCTTCAAGATTACCCAGTCACCGTGGCCTCCAACCTGCAGGACGAGGAGCT
CTGCGGGGGCCTCTGGCGGCTGGTCCTGGCACAGCGCTGGATGGAGCGGCTCAAGACTGTCGCTGG
GTCCAAGATGCAAGGCTTGCTGGAGCGCGTGAACACGGAGATACACTTTGTCACCAAATGTGCCTT
TCAGCCCCCCCCCAGCTGTCTTCGCTTCGTCCAGACCAACATCTCCCGCCTCCTGCAGGAGACCTC
CGAGCAGCTGGTGGCGCTGAAGCCCTGGATCACTCGCCAGAACTTCTCCCGGTGCCTGGAGCTGCA
GTGTCAGCCCGACTCCTCAACCCTGTACGTAGAGGGCGGTGGAGGCTCCCCGGGTGGTGGTTCTGG
CGGCGGCTCCAACATGGCTACACCATTGGGCCCTGCCAGCTCCCTGCCCCAGAGCTTCCTGCTCAA
```

TABLE 2-continued

GENE SEQUENCES

GTCTTTAGAGCAAGTGAGAAAGATCCAGGGCGATGGCGCAGCGCTCCAGGAGAAGCTGTGTGCCAC
CTACAAGCTGTGCCACCCCGAGGAGCTGGTGCTGCTCGGACACTCTCTGGGCATCCCCTGGGCTCC
CCTGAGCTCCTGCCCCAGCCAGGCCCTGCAGCTGGCAGGCTGCTTGAGCCAACTCCATAGCGGCCT
TTTCCTCTACCAGGGGCTCCTGCAGGCCCTGGAAGGGATATCCCCCGAGTTGGGTCCCACCTTGGA
CACACTGCAGCTGGACGTCGCCGACTTTGCCACCACCATCTGGCAGCAGATGGAAGAACTGGGAAT
GGCCCCTGCCCTGCAGCCCACCCAGGGTGCCATGCCGGCCTTCGCCTCTGCTTTCCAGCGCCGGGC
AGGAGGGGTCCTGGTTGCTAGCCATCTGCAGAGCTTCCTGGAGGTGTCGTACCGCGTTCTACGCCA
CCTTGCGCAGCCG SEQ ID NO:198
pMON32397.seq GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCCGATTACCCAGTCACCGTGGCC
TCCAACCTGCAGGACGAGGAGCTCTGCGGGGGCCTCTGGCGGCTGGTCCTGGCACAGCGCTGGATG
GAGCGGCTCAAGACTGTCGCTGGGTCCAAGATGCAAGGCTTGCTGGAGCGCGTGAACACGGAGATA
CACTTTGTCACCAAATGTGCCTTTCAGCCCCCCCCCAGCTGTCTTCGCTTCGTCCAGACCAACATC
TCCCGCCTCCTGCAGGAGACCTCCGAGCAGCTGGTGGCGCTGAAGCCCTGGATCACTCGCCAGAAC
TTCTCCCGGTGCCTGGAGCTGCAGTGTCAGCCCGACTCCTCAACCCTGGGCGGTGGGTCAGGAGGT
GGATCCGGAGGTACCCAGGACTGCTCCTTCCAACACAGCCCCATCTCCTCCGACTTCGCTGTCAAA
ATCCGTGAGCTGTCTGACTACCTGCTTCAA SEQ ID NO:199
pMON32398.seq GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCCGATTACCCAGTCACCGTGGCC
TCCAACCTGCAGGACGAGGAGCTCTGCGGGGGCCTCTGGCGGCTGGTCCTGGCACAGCGCTGGATG
GAGCGGCTCAAGACTGTCGCTGGGTCCAAGATGCAAGGCTTGCTGGAGCGCGTGAACACGGAGATA
CACTTTGTCACCAAATGTGCCTTTCAGCCCCCCCCCAGCTGTCTTCGCTTCGTCCAGACCAACATC
TCCCGCCTCCTGCAGGAGACCTCCGAGCAGCTGGTGGCGCTGAAGCCCTGGATCACTCGCCAGAAC
TTCTCCCGGTGCCTGGAGCTGCAGTGTCAGCCCGACTCCTCAACCCTGGGCGGTGGGTCAGGAGGT
GGGTCAGGAGGTGGATCCGGAGGTGGCACCCAGGACTGCTCCTTCCAACACAGCCCCATCTCCTCC
GACTTCGCTGTCAAAATCCGTGAGCTGTCTGACTACCTGCTTCAA SEQ ID NO:200
pMON32399.seq GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCCGCCTCCAACCTGCAGGACGAG
GAGCTCTGCGGGGGCCTCTGGCGGCTGGTCCTGGCACAGCGCTGGATGGAGCGGCTCAAGACTGTC
GCTGGGTCCAAGATGCAAGGCTTGCTGGAGCGCGTGAACACGGAGATACACTTTGTCACCAAATGT
GCCTTTCAGCCCCCCCCCAGCTGTCTTCGCTTCGTCCAGACCAACATCTCCCGCCTCCTGCAGGAG
ACCTCCGAGCAGCTGGTGGCGCTGAAGCCCTGGATCACTCGCCAGAACTTCTCCCGGTGCCTGGAG
CTGCAGTGTCAGCCCGACTCCTCAACCCTGGGCGGTGGGTCAGGAGGTGGATCCGGAGGTACCCAG
GACTGCTCCTTCCAACACAGCCCCATCTCCTCCGACTTCGCTGTCAAAATCCGTGAGCTGTCTGAC
TACCTGCTTCAAGATTACCCAGTCACCGTG SEQ ID NO:201
pMON35700.seq GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAAGGCGGTGGAGGCTCCCCGGGTGAACCGTCTGGTCCAATCTCTACTATCAAC
CCGTCTCCTCCGTCTAAAGAATCTCATAAATCTCCAAACATGGCCGCCTCCAACCTGCAGGACGAG
GAGCTCTGCGGGGGCCTCTGGCGGCTGGTCCTGGCACAGCGCTGGATGGAGCGGCTCAAGACTGTC
GCTGGGTCCAAGATGCAAGGCTTGCTGGAGCGCGTGAACACGGAGATACACTTTGTCACCAAATGT
GCCTTTCAGCCCCCCCCCAGCTGTCTTCGCTTCGTCCAGACCAACATCTCCCGCCTCCTGCAGGAG
ACCTCCGAGCAGCTGGTGGCGCTGAAGCCCTGGATCACTCGCCAGAACTTCTCCCGGTGCCTGGAG
CTGCAGTGTCAGCCCGACTCCTCAACCCTGGGCGGTGGGTCAGGAGGTGGGTCAGGAGGTGGATCC
GGAGGTGGCACCCAGGACTGCTCCTTCCAACACAGCCCCATCTCCTCCGACTTCGCTGTCAAAATC
CGTGAGCTGTCTGACTACCTGCTTCAAGATTACCCAGTCACCGTG SEQ ID NO:202
pMON35701.seq GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT

TABLE 2-continued

GENE SEQUENCES

```
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCCGTCGCTGGGTCCAAGATGCAA
GGCTTGCTGGAGCGCGTGAACACGGAGATACACTTTGTCACCAAATGTGCCTTTCAGCCCCCCCCC
AGCTGTCTTCGCTTCGTCCAGACCAACATCTCCCGCCTCCTGCAGGAGACCTCCGAGCAGCTGGTG
GCGCTGAAGCCCTGGATCACTCGCCAGAACTTCTCCCGGTGCCTGGAGCTGCAGTGTCAGCCCGAC
TCCTCAACCCTGGGCGGTGGGTCAGGAGGTGGATCCGGAGGTACCCAGGACTGCTCCTTCCAACAC
AGCCCCATCTCCTCCGACTTCGCTGTCAAAATCCGTGAGCTGTCTGACTACCTGCTTCAAGATTAC
CCAGTCACCGTGGCCTCCAACCTGCAGGACGAGGAGCTCTGCGGGGGCCTCTGGCGGCTGGTCCTG
GCACAGCGCTGGATGGAGCGGCTCAAGACT SEQ ID NO:203
pMON35702.seq GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCCGTCGCTGGGTCCAAGATGCAA
GGCTTGCTGGAGCGCGTGAACACGGAGATACACTTTGTCACCAAATGTGCCTTTCAGCCCCCCCCC
AGCTGTCTTCGCTTCGTCCAGACCAACATCTCCCGCCTCCTGCAGGAGACCTCCGAGCAGCTGGTG
GCGCTGAAGCCCTGGATCACTCGCCAGAACTTCTCCCGGTGCCTGGAGCTGCAGTGTCAGCCCGAC
TCCTCAACCCTGGGCGGTGGGTCAGGAGGTGGGTCAGGAGGTGGATCCGGAGGTGGCACCCAGGAC
TGCTCCTTCCAACACAGCCCCATCTCCTCCGACTTCGCTGTCAAAATCCGTGAGCTGTCTGACTAC
CTGCTTCAAGATTACCCAGTCACCGTGGCCTCCAACCTGCAGGACGAGGAGCTCTGCGGGGGCCTC
TGGCGGCTGGTCCTGGCACAGCGCTGGATGGAGCGGCTCAAGACT SEQ ID NO:204
pMON35703.seq GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCCCGCTTCGTCCAGACCAACATC
TCCCGCCTCCTGCAGGAGACCTCCGAGCAGCTGGTGGCGCTGAAGCCCTGGATCACTCGCCAGAAC
TTCTCCCGGTGCCTGGAGCTGCAGTGTCAGCCCGACTCCTCAACCCTGGGCGGTGGGTCAGGAGGT
GGATCCGGAGGTACCCAGGACTGCTCCTTCCAACACAGCCCCATCTCCTCCGACTTCGCTGTCAAA
ATCCGTGAGCTGTCTGACTACCTGCTTCAAGATTACCCAGTCACCGTGGCCTCCAACCTGCAGGAC
GAGGAGCTCTGCGGGGGCCTCTGGCGGCTGGTCCTGGCACAGCGCTGGATGGAGCGGCTCAAGACT
GTCGCTGGGTCCAAGATGCAAGGCTTGCTGGAGCGCGTGAACACGGAGATACACTTTGTCACCAAA
TGTGCCTTTCAGCCCCCCCCCAGCTGTCTT SEQ ID NO:205
pMON35704.seq GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCCCGCTTCGTCCAGACCAACATC
TCCCGCCTCCTGCAGGAGACCTCCGAGCAGCTGGTGGCGCTGAAGCCCTGGATCACTCGCCAGAAC
TTCTCCCGGTGCCTGGAGCTGCAGTGTCAGCCCGACTCCTCAACCCTGGGCGGTGGGTCAGGAGGT
GGGTCAGGAGGTGGATCCGGAGGTGGCACCCAGGACTGCTCCTTCCAACACAGCCCCATCTCCTCC
GACTTCGCTGTCAAAATCCGTGAGCTGTCTGACTACCTGCTTCAAGATTACCCAGTCACCGTGGCC
TCCAACCTGCAGGACGAGGAGCTCTGCGGGGGCCTCTGGCGGCTGGTCCTGGCACAGCGCTGGATG
GAGCGGCTCAAGACTGTCGCTGGGTCCAAGATGCAAGGCTTGCTGGAGCGCGTGAACACGGAGATA
CACTTTGTCACCAAATGTGCCTTTCAGCCCCCCCCCAGCTGTCTT SEQ ID NO:206
pMON35705.seq GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAAGCTCCCCGGGTGAACCGTCTGGTCCAATCTCTACTATCAAC
CCGTCTCCTCCGTCTAAAGAATCTCATAAATCTCCAAACATGGCCACCAACATCTCCCGCCTCCTG
CAGGAGACCTCCGAGCAGCTGGTGGCGCTGAAGCCCTGGATCACTCGCCAGAACTTCTCCGGTGCC
TGGAGCTGCAGTGTCAGCCCGACTCCTCAACCCTGGGCGGTGGGTCAGGAGGTGGATCCGGAGGT
ACCCAGGACTGCTCCTTCCAACACAGCCCCATCTCCTCCGACTTCGCTGTCAAAATCCGTGAGCTG
TCTGACTACCTGCTTCAAGATTACCCAGTCACCGTGGCCTCCAACCTGCAGGACGAGGAGCTCTGC
GGGGGCCTCTGGCGGCTGGTCCTGGCACAGCGCTGGATGGAGCGGCTCAAGACTGTCGCTGGGTCC
AAGATGCAAGGCTTGCTGGAGCGCGTGAACACGGAGATACACTTTGTCACCAAATGTGCCTTTCAG
CCCCCCCCCAGCTGTCTTCGCTTCGTCCAG SEQ ID NO:207
```

TABLE 2-continued

GENE SEQUENCES pMON35706.seq

GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCAATCTCTACTATCAAC
CCGTCTCCTCCGTCTAAAGAATCTCATAAATCTCCAAACATGGCCACCAACATCTCCCGCCTCCTG
CAGGAGACCTCCGAGCAGCTGGTGGCGCTGAAGCCCTGGATCACTCGCCAGAACTTCTCCCGGTGC
CTGGAGCTGCAGTGTCAGCCCGACTCCTCAACCCTGGGCGGTGGGTCAGGAGGTGGGTCAGGAGGT
GGATCCGGAGGTGGCACCCAGGACTGCTCCTTCCAACACAGCCCCATCTCCTCCGACTTCGCTGTC
AAAATCCGTGAGCTGTCTGACTACCTGCTTCAAGATTACCCAGTCACCGTGGCCTCCAACCTGCAG
GACGAGGAGCTCTGCGGGGGCCTCTGGCGGCTGGTCCTGGCACAGCGCTGGATGGAGCGGCTCAAG
ACTGTCGCTGGGTCCAAGATGCAAGGCTTGCTGGAGCGCGTGAACACGGAGATACACTTTGTCACC
AAATGTGCCTTTCAGCCCCCCCCCAGCTGTCTTCGCTTCGTCCAG SEQ ID NO:208 pMON35733.seq

GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCAATCTCTACTATCAAC
CCGTCTCCTCCGTCTAAAGAATCTCATAAATCTCCAAACATGGCTTCTAATCTGCAAGATGAAGAG
CTGTGCGGGGGCCTCTGGCGGCTGGTCCTGGCACAGCGCTGGATGGAGCGGCTCAAGACTGTCGCT
GGGTCCAAGATGCAAGGCTTGCTGGAGCGCGTGAACACGGAGATACACTTTGTCACCAAATGTGCC
TTTCAGCCCCCCCCCAGCTGTCTTCGCTTCGTCCAGACCAACATCTCCCGCCTCCTGCAGGAGACC
TCCGAGCAGCTGGTGGCGCTGAAGCCCTGGATCACTCGCCAGAACTTCTCCCGGTGCCTGGAGCTG
CAGTGTCAGCCCGACTCCTCAACCCTGGGCGGTGGGTCAGGAGGTGGGTCAGGAGGTGGATCCGGA
GGTGGCTCAGGGGGAGGTAGTGGTACCCAGGACTGCTCCTTCCAACACAGCCCCATCTCCTCCGAC
TTCGCTGTCAAAATCCGTGAGCTGTCTGACTACCTGCTTCAAGATTACCCAGTCACCGTGGCC SEQ ID NO:209 pMON35734.seq

GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCAATCTCTACTATCAAC
CCGTCTCCTCCGTCTAAAGAATCTCATAAATCTCCAAACATGGCCAACCTGCAAGATGAAGAGCTG
TGTGGGGGCCTCTGGCGGCTGGTCCTGGCACAGCGCTGGATGGAGCGGCTCAAGACTGTCGCTGGG
TCCAAGATGCAAGGCTTGCTGGAGCGCGTGAACACGGAGATACACTTTGTCACCAAATGTGCCTTT
CAGCCCCCCCCCAGCTGTCTTCGCTTCGTCCAGACCAACATCTCCCGCCTCCTGCAGGAGACCTCC
GAGCAGCTGGTGGCGCTGAAGCCCTGGATCACTCGCCAGAACTTCTCCCGGTGCCTGGAGCTGCAG
TGTCAGCCCGACTCCTCAACCCTGGGCGGTGGGTCAGGAGGTGGGTCAGGAGGTGGATCCGGAGGT
GGCTCAGGGGGAGGTAGTGGTACCCAGGACTGCTCCTTCCAACACAGCCCCATCTCCTCCGACTTC
GCTGTCAAAATCCGTGAGCTGTCTGACTACCTGCTTCAAGATTACCCAGTCACCGTGGCCTCC SEQ ID NO:210 pMON35735.seq

GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCAATCTCTACTATCAAC
CCGTCTCCTCCGTCTAAAGAATCTCATAAATCTCCAAACATGGCTCTGCAGGATGAGGAACTGTGC
GGCGGCCTCTGGCGGCTGGTCCTGGCACAGCGCTGGATGGAGCGGCTCAAGACTGTCGCTGGGTCC
AAGATGCAAGGCTTGCTGGAGCGCGTGAACACGGAGATACACTTTGTCACCAAATGTGCTTTTCAG
CCCCCCCCCAGCTGTCTTCGCTTCGTCCAGACCAACATCTCCCGCCTCCTGCAGGAGACCTCCGAG
CAGCTGGTGGCGCTGAAGCCCTGGATCACTCGCCAGAACTTCTCCCGGTGCCTGGAGCTGCAGTGT
CAGCCCGACTCCTCAACCCTGGGCGGTGGGTCAGGAGGTGGGTCAGGAGGTGGATCCGGAGGTGGC
TCAGGGGGAGGTAGTGGTACCCAGGACTGCTCCTTCCAACACAGCCCCATCTCCTCCGACTTCGCT
GTCAAAATCCGTGAGCTGTCTGACTACCTGCTTCAAGATTACCCAGTCACCGTGGCCTCCAAC SEQ ID NO:211 pMON35736.seq

GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCAATCTCTACTATCAAC
CCGTCTCCTCCGTCTAAAGAATCTCATAAATCTCCAAACATGGCTCAAGATGAAGAGCTGTGTGGT
GGTCTCTGGCGGCTGGTCCTGGCACAGCGCTGGATGGAGCGGCTCAAGACTGTCGCTGGGTCCAAG

TABLE 2-continued

GENE SEQUENCES

```
ATGCAAGGCTTGCTGGAGCGCGTGAACACGGAGATACACTTTGTCACCAAATGTGCCTTTCAGCCC
CCCCCCAGCTGTCTTCGCTTCGTCCAGACCAACATCTCCCGCCTCCTGCAGGAGACCTCCGAGCAG
CTGGTGGCGCTGAAGCCCTGGATCACTCGCCAGAACTTCTCCCGGTGCCTGGAGCTGCAGTGTCAG
CCCGACTCCTCAACCCTGGGCGGTGGGTCAGGAGGTGGGTCAGGAGGTGGATCCGGAGGTGGCTCA
GGGGGAGGTAGTGGTACCCAGGACTGCTCCTTCCAACACAGCCCCATCTCCTCCGACTTCGCTGTC
AAAATCCGTGAGCTGTCTGACTACCTGCTTCAAGATTACCCAGTCACCGTGGCCTCCAACCTG
SEQ ID NO:212
```
pMON35738.seq

```
GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCTGAAGAACTGTGTGGTGGTCTG
TGGCGGCTGGTCCTGGCACAGCGCTGGATGGAGCGGCTCAAGACTGTCGCTGGGTCCAAGATGCAA
GGCTTGCTGGAGCGCGTGAACACGGAGATACACTTTGTCACCAAATGTGCCTTTCAGCCCCCCCCC
AGCTGTCTTCGCTTCGTCCAGACCAACATCTCCCGCCTCCTGCAGGAGACCTCCGAGCAGCTGGTG
GCGCTGAAGCCCTGGATCACTCGCCAGAACTTCTCCCGGTGCCTGGAGCTGCAGTGTCAGCCCGAC
TCCTCAACCCTGGGCGGTGGGTCAGGAGGTGGGTCAGGAGGTGGATCCGGAGGTGGCTCAGGGGGA
GGTAGTGGTACCCAGGACTGCTCCTTCCAACACAGCCCCATCTCCTCCGACTTCGCTGTCAAAATC
CGTGAGCTGTCTGACTACCTGCTTCAAGATTACCCAGTCACCGTGGCCTCCAACCTGCAGGAC
SEQ ID NO:213
```
pMON35739.seq

```
GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCTGAGCTGTGTGGTGGCCTGTGG
CGTCTGGTCCTGGCACAGCGCTGGATGGAGCGGCTCAAGACTGTCGCTGGGTCCAAGATGCAAGGC
TTGCTGGAGCGCGTGAACACGGAGATACACTTTGTCACCAAATGTGCCTTTCAGCCCCCCCCCAGC
TGTCTTCGCTTCGTCCAGACCAACATCTCCCGCCTCCTGCAGGAGACCTCCGAGCAGCTGGTGGCG
CTGAAGCCCTGGATCACTCGCCAAAACTTCTCCCGGTGCCTGGAGCTGCAGTGTCAGCCCGACTCC
TCAACCCTGGGCGGTGGGTCAGGAGGTGGGTCAGGAGGTGGATCCGGAGGTGGCTCAGGGGGAGGT
AGTGGTACCCAGGACTGCTCCTTCCAACACAGCCCCATCTCCTCCGACTTCGCTGTCAAAATCCGT
GAGCTGTCTGACTACCTGCTTCAAGATTACCCAGTCACCGTGGCCTCCAACCTGCAGGACGAG
SEQ ID NO:214
```
pMON35740.seq

```
GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCTCTGTGCGGTGGTCTGTGGCGT
CTGGTCCTGGCACAGCGCTGGATGGAGCGGCTCAAGACTGTCGCTGGGTCCAAGATGCAAGGCTTG
CTGGAGCGCGTGAACACGGAGATACACTTTGTCACCAAATGTGCCTTTCAGCCCCCCCCAGCTGT
CTTCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCAGCCCGACTCCTCA
ACCCTGGGCGGTGGGTCAGGAGGTGGGTCAGGAGGTGGATCCGGAGGTGGCTCAGGGGGAGGTAGT
GGTACCCAGGACTGCTCCTTCCAACACAGCCCCATCTCCTCCGACTTCGCTGTCAAAATCCGTGAG
CTGTCTGACTACCTGCTTCAAGATTACCCAGTCACCGTGGCCTCCAACCTGCAGGACGAGGAG
SEQ ID NO:215
```
pMON35741.seq

```
GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCTTCTAATCTGCAAGATGAAGAG
CTGTGCGGGGCCTCTGGCGGCTGGTCCTGGCACAGCGCTGGATGGAGCGGCTCAAGACTGTCGCT
GGGTCCAAGATGCAAGGCTTGCTGGAGCGCGTGAACACGGAGATACACTTTGTCACCAAATGTGCC
TTTCAGCCCCCCCCCAGCTGTCTTCGCTTCGTCCAGACCAACATCTCCCGCCTCCTGCAGGAGACC
TCCGAGCAGCTGGTGGCGCTGAAGCCCTGGATCACTCGCCAGAACTTCTCCCGGTGCCTGGAGCTG
CAGTGTCAGCCCGACTCCTCAACCCTGGGCGGTGGGTCAGGAGGTGGGTCAGGAGGTGGATCCGGA
GGTGGCTCAGGGGGAGGTAGTGGTACCCAGGACTGCTCCTTCCAACACAGCCCCATCTCCTCCGAC
TCCGCTGTCAAAATCCGTGAGCTGTCTGACTACCTGCTTCAAGATTACCCAGTCACCGTGGCC
SEQ ID NO:216
```

TABLE 2-continued

GENE SEQUENCES pMON35742.seq

GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCTCAAGATGAAGAACTGTGCGGT
GGTCTCTGGCGGCTGGTCCTGGCACAGCGCTGGATGGAGCGGCTCAAGACTGTCGCTGGGTCCAAG
ATGCAAGGCTTGCTGGAGCGCGTGAACACGGAGATACACTTTGTCACCAAATGTGCCTTTCAGCCC
CCCCCCAGCTGTCTTCGCTTCGTCCAGACCAACATCTCCCGCCTCCTGCGGGAGACCTCCGAGCAG
CCGGTGGCGCTGAAGCCCTGGATCACTCGCCAGAACTTCTCCCGGTGCCTGGAGCTGCAGTGTCAG
CCCGACTCCTCAACCCTGGGCGGTGGGTCAGGAGGTGGGTCAGGAGGTGGATCCGGAGGTGGCTCA
GGGGGAGGTAGTGGTACCCAGGACTGCTCCTTCCAACACAGCCCCATCTCCTCCGACTTCGCTGTC
AAAATCCGTGAGCTGTCTGACTACCTGCTTCAAGATTACCCAGTCACCGTGGCCTCCAACCTG
SEQ ID NO:217
pMON35743.seq GCTAACTGCTCTATAATGATCGATGAAATTATACATCACTTAAAGAGACCACCTAACCCTTTGCTG
GACCCGAACAACCTCAATTCTGAAGACATGGATATCCTGATGGAACGAAACCTTCGAACTCCAAAC
CTGCTCGCATTCGTAAGGGCTGTCAAGCACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCTCTGTGCGGTGGTCTGTGGCGT
CTGGTCCTGGCACAGCGCTGGATGAGCGGCTCAAGACTGTCGCTGGGTCCAAGATGCAAGGCTTG
CTGGAGCGCGTGAACACGGAGATACACTTTGTCACCAAATGTGCCTTTCAGCCCCCCCCCAGCTGT
CTTCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCGGCCCGACTCCTCA
ACCCTGGGCGGTGGGTCAGGAGGTGGGTCAGGAGGTGGATCCGGAGGTGGCTCAGGGGGAGGTAGT
GGTACCCAGGACTGCTCCTTCCAACACAGCCCCATCTCCTCCGACTTCGCTGTCAAGATCCGTGAG
CTGTCTGACTACCTGCTTCAAGATTACCCAGTCACCGTGGCCTCCAACCTGCAGGACGAGGAG
SEQ ID NO:218
pMON32179.seq GCTGATGAAGAACTGTGTGGTGGTCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCTAACTGCTCTATAATGATCGAT
GAAATTATACATCACTTAAAGAGACCACCTAACCCTTTGCTGGACCCGAACAACCTCAATTCTGAA
GACATGGATATCCTGATGGAACGAAACCTTCGAACTCCAAACCTGCTCGCATTCGTAAGGGCTGTC
AAGCACTTAGAAAATGCATCAGGTATTGAGGCAATTCTTCGTAATCTCCAACCATGTCTGCCCTCT
GCCACGGCCGCACCCTCTCGACATCCAATCATCATCAAGGCAGGTGACTGGCAAGAATTCCGGGAA
AAACTGACGTTCTATCTGGTTACCCTTGAGCAAGCGCAGGAACAACAG SEQ ID NO:219
pMON35707.seq GCGGATGAGGAGCTGTGCGGTGGCCTCTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAGGCCCTGGATCACTCGCCAGAACTTCTCCCGG
TGCCTGGAGCTGCAGTGTCAGCCCGACTCCTCAACCCTGGGCGGTGGGTCAGGAGGTGGATCCGGA
GGTACCCAGGACTGCTCCTTCCAACACAGCCCCATCTCCTCCGACTTCGCTGTCAAAATCCGTGAG
CTGTCTGACTACCTGCTTCAAGATTACCCAGTCACCGTGGCCTCCAACCTGCAGTACGTAGAGGGC
GGTGGAGGCTCCCCGGGTGAACCGTCTGGTCCAATCTCTACTATCAACCCGTCTCCTCCGTCTAAA
GAATCTCATAAATCTCCAAACATGGCTAACTGCTCTATAATGATCGATGAAATTATACATCACTTA
AAGAGACCACCTAACCCTTTGCTGGACCCGAACAACCTCAATTCTGAAGACATGGATATCCTGATG
GAACGAAACCTTCGAACTCCAAACCTGCTCGCATTCGTAAGGGCTGTCAAGCACTTAGAAAATGCA
TCAGGTATTGAGGCAATTCTTCGTAATCTCCAACCATGTCTGCCCTCTGCCACGGCCGCACCCTCT
CGACATCCAATCATCATCAAGGCAGGTGACTGGCAAGAATTCCGGGAAAAACTGACGTTCTATCTG
GTTACCCTTGAGCAAGCGCAGGAACAACAG SEQ ID NO:220
pMON35708.seq GCCGACGAGGAGCTGTGCGGTGGCCTCTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGAACCCAGGACTGCTCCTTCCAACACAGCCCCATCTCCTCCGACTTCGCT
GTCAAAATCCGTGAGCTGTCTGACTACCTGCTTCAAGATTACCCAGTCACCGTGGCCTCCAACCTG
CAGTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTAACTGCTCTATAATGATCGATGAA

TABLE 2-continued

GENE SEQUENCES

ATTATACATCACTTAAAGAGACCACCTAACCCTTTGCTGGACCCGAACAACCTCAATTCTGAAGAC
ATGGATATCCTGATGGAACGAAACCTTCGAACTCCAAACCTGCTCGCATTCGTAAGGGCTGTCAAG
CACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAA
CTGACGTTCTATCTGGTTACCCTTGAGCAAGCGCAGGAACAACAG SEQ ID NO:221
pMON35709.seq GCAGACGAGGAGCTGTGCGGTGGCCTCTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTAACTGC
TCTATAATGATCGATGAAATTATACATCACTTAAAGAGACCACCTAACCCTTTGCTGGACCCGAAC
AACCTCAATTCTGAAGACATGGATATCCTGATGGAACGAAACCTTCGAACTCCAAACCTGCTCGCA
TTCGTAAGGGCTGTCAAGCACTTAGAAAATGCATCAGGTATTGAGGCAATTCTTCGTAATCTCCAA
CCATGTCTGCCCTCTGCCACGGCCGCACCCTCTCGACATCCAATCATCATCAAGGCAGGTGACTGG
CAAGAATTCCGGGAAAAACTGACGTTCTATCTGGTTACCCTTGAGCAAGCGCAGGAACAACAG
SEQ ID NO:222
pMON35710.seq GCGGACGAGGAGCTGTGCGGTGGCCTCTGGCGGCTGGTCCTGGCACAGCGCTGGATGGAGCGGCTC
AAGACTGTCGCTGGGTCCAAGATGCAAGGCCTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGAACCCAGGACTGCTCCTTCCAACACAGCCCCATCTCCTCCGACTTCGCT
GTCAAAATCCGTGAGCTGTCTGACTACCTGCTTCAAGATTACCCAGTCACCGTGGCCTCCAACCTG
CAGTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTAACTGCTCTATAATGATCGATGAA
ATTATACATCACTTAAAGAGACCACCTAACCCTTTGCTGGACCCGAACAACCTCAATTCTGAAGAC
ATGGATATCCTGATGGAACGAAACCTTCGAACTCCAAACCTGCTCGCATTCGTAAGGGCTGTCAAG
CACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAA
CTGACGTTCTATCTGGTTACCCTTGAGCAAGCGCAGGAACAACAG SEQ ID NO:223
pMON35711.seq GCGGATGAGGAGCTGTGTGGTGGCCTCTGGCGGCTGGTCCTGGCACAGCGCTGGATGGGGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTAACTGC
TCTATAATGATCGATGAAATTATACATCACTTAAAGAGACCACCTAACCCTTTGCTGGACCCGAAC
AACCTCAATTCTGAAGACATGGATATCCTGATGGAACGAAACCTTCGAACTCCAAACCTGCTCGCA
TTCGTAAGGGCTGTCAAGCACTTAGAAAATGCATCAGGTATTGAGGCAATTCTTCGTAATCTCCAA
CCATGTCTGCCCTCTGCCACGGCCGCACCCTCTCGACATCCAATCATCATCAAGGCAGGTGACTGG
CAAGAATTCCGGGAAAAACTGACGTTCTATCTGGTTACCCTTGAGCAAGCGCAGGAACAACAG
SEQ ID NO:224
pMON35719.seq GGCCGATTACCCAGTCACCGTGGCCTCCAACCTGCAGGACGAGGAGCTCTGCGGGGCCTCTGGCG
GCTGGTCCTGGCACAGCGCTGGATGGAGCGGCTCAAGACTGTCGCTGGGTCCAAGATGCAAGGCTT
GCTGGAGCGCGTGAACACGGAGATACACTTTGTCACCAAATGTGCCTTTCAGCCCCCCCCCAGCTG
TCTTCGCTTCGTCCAGACCAACATCTCCCGCCTCCTGCAGGAGACCTCCGAGCAGCTGGTGGCGCT
GAAGCCCTGGATCACTCGCCAGAACTTCTCCCGGTGCCTGGAGCTGCAGTGTCAGCCCGACTCCTC
AACCCTGGGCGGTGGGTCAGGAGGTGGGTCAGGAGGTGGATCCGGAGGTGGCACCCAGGACTGCTC
CTTCCAACACAGCCCCATCTCCTCCGACTTCGCTGTCAAAATCCGTGAGCTGTCTGACTACCTGCT
TCAATACGTAGAGGGCGGTGGAGGCTCCCCGGGTGAACCGTCTGGTCCAATCTCTACTATCAACCC
GTCTCCTCCGTCTAAAGAATCTCATAAATCTCCAAACATGGCTAACTGCTCTATAATGATCGATGA
AATTATACATCACTTAAAGAGACCACCTAACCCTTTGCTGGACCCGAACAACCTCAATTCTGAAGA
CATGGATATCCTGATGGAACGAAACCTTCGAACTCCAAACCTGCTCGCATTCGTAAGGGCTGTCAA
GCACTTAGAAAATGCATCAGGTATTGAGGCAATTCTTCGTAATCTCCAACCATGTCTGCCCTCTGC
CACGGCCGCACCCTCTCGACATCCAATCATCATCAAGGCAGGTGACTGGCAAGAATTCCGGGAAAA
ACTGACGTTCTATCTGGTTACCCTTGAGCAAGCGCAGGAACAACAG SEQ ID NO:225
pMON35720.seq GCCGCCTCCAACCTGCAGGACGAGGAGCTCTGCGGGGCCTCTGGCGGCTGGTCCTGGCACAGCGC
TGGATGGAGCGGCTCAAGACTGTCGCTGGGTCCAAGATGCAAGGCTTGCTGGAGCGCGTGAACACG
GAGATACACTTTGTCACCAAATGTGCCTTTCAGCCCCCCCCCAGCTGTCTTCGCTTCGTCCAGACC
AACATCTCCCGCCTCCTGCAGGAGACCTCCGAGCAGCTGGTGGCGCTGAAGCCCTGGATCACTCGC

TABLE 2-continued

GENE SEQUENCES

CAGAACTTCTCCCGGTGCCTGGAGCTGCAGTGTCAGCCCGACTCCTCAACCCTGGGCGGTGGGTCA
GGAGGTGGGTCAGGAGGTGGATCCGGAGGTGGCACCCAGGACTGCTCCTTCCAACACAGCCCCATC
TCCTCCGACTTCGCTGTCAAAATCCGTGAGCTGTCTGACTACCTGCTTCAAGATTACCCAGTCACC
GTGTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTAACTGCTCTATAATGATCGATGAA
ATTATACATCACTTAAAGAGACCACCTAACCCTTTGCTGGACCCGAACAACCTCAATTCTGAAGAC
ATGGATATCCTGATGGAACGAAACCTTCGAACTCCAAACCTGCTCGCATTCGTAAGGGCTGTCAAG
CACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAA
CTGACGTTCTATCTGGTTACCCTTGAGCAAGCGCAGGAACAACAG SEQ ID NO:226
pMON35721.seq GCCGTCGCTGGGTCCAAGATGCAAGGCTTGCTGGAGCGCGTGAACACGGAGATACACTTTGTCACC
AAATGTGCCTTTCAGCCCCCCCCAGCTGTCTTCGCTTCGTCCAGACCAACATCTCCCGCCTCCTG
CAGGAGACCTCCGAGCAGCTGGTGGCGCTGAAGCCCTGGATCACTCGCCAGAACTTCTCCCGGTGC
CTGGAGCTGCAGTGTCAGCCCGACTCCTCAACCCTGGGCGGTGGGTCAGGAGGTGGGTCAGGAGGT
GGATCCGGAGGTGGCACCCAGGACTGCTCCTTCCAACACAGCCCCATCTCCTCCGACTTCGCTGTC
AAAATCCGTGAGCTGTCTGACTACCTGCTTCAGGATTACCCAGTCACCGTGGCCTCCAACCTGCAG
GACGAGGAGCTCTGCGGGGGCCTCTGGCGGCTGGTCCTGGCACAGCGCTGGATGGAGCGGCTCAAG
ACTTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTAACTGCTCTATAATGATCGATGAA
ATTATACATCACTTAAAGAGACCACCTAACCCTTTGCTGGACCCGAACAACCTCAATTCTGAAGAC
ATGGATATCCTGATGGAACGAAACCTTCGAACTCCAAACCTGCTCGCATTCGTAAGGGCTGTCAAG
CACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAA
CTGACGTTCTATCTGGTTACCCTTGAGCAAGCGCAGGAACAACAG SEQ ID NO:227
pMON35722.seq GCCTCCAAGATGCAAGGCTTGCTGGAGCGCGTGAACACGGAGATACACTTTGTCACCAAATGTGCC
TTTCAGCCCCCCCCAGCTGTCTTCGCTTCGTCCAGACCAACATCTCCCGCCTCCTGCAGGAGACC
TCCGAGCAGCTGGTGGCGCTGAAGCCCTGGATCACTCGCCAGAACTTCTCCCGGTGCCTGGAGCTG
CAGTGTCAGCCCGACTCCTCAACCCTGGGCGGTGGGTCAGGAGGTGGGTCAGGAGGTGGATCCGGA
GGTGGCACCCAGGACTGCTCCTTCCAACACAGCCCCATCTCCTCCGACTTCGCTGTCAAAATCCGT
GAGCTGTCTGACTACCTGCTTCAAGATTACCCAGTCACCGTGGCCTCCAACCTGCAGGACGAGGAG
CTCTGCGGGGGCCTCTGGCGGCTGGTCCTGGCACAGCGCTGGATGGAGCGGCTCAAGACTGTCGCT
GGCTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTAACTGCTCTATAATGATCGATGAA
ATTATACATCACTTAAAGAGACCACCTAACCCTTTGCTGGACCCGAACAACCTCAATTCTGAAGAC
ATGGATATCCTGATGGAACGAAACCTTCGAACTCCAAACCTGCTCGCATTCGTAAGGGCTGTCAAG
CACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAA
CTGACGTTCTATCTGGTTACCCTTGAGCAAGCGCAGGAACAACAG SEQ ID NO:228
pMON35723.seq GCCCCCCCCAGCTGTCTTCGCTTCGTCCAGACCAACATCTCCCGCCTCCTGCAGGAGACCTCCGAG
CAGCTGGTGGCGCTGAAGCCCTGGATCACTCGCCAGAACTTCTCCCGGTGCCTGGAGCTGCAGTGT
CAGCCCGACTCCTCAACCCTGGGCGGTGGGTCAGGAGGTGGGTCAGGAGGTGGATCCGGAGGTGGC
ACCCAGGACTGCTCCTTCCAACACAGCCCCATCTCCTCCGACTTCGCTGTCAAAATCCGTGAGCTG
TCTGACTACCTGCTTCAAGATTACCCAGTCACCGTGGCCTCCAACCTGCAGGACGAGGAGCTCTGC
GGGGGCCTCTGGCGGCTGGTCCTGGCACAGCGCTGGATGGAGCGGCTCAAGACTGTCGCTGGGTCC
AAGATGCAAGGCTTGCTGGAGCGCGTGAACACGGAGATACACTTTGTCACCAAATGTGCCTTTCAG
CCGTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTAACTGCTCTATAATGATCGATGAA
ATTATACATCACTTAAAGAGACCACCTAACCCTTTGCTGGACCCGAACAACCTCAATTCTGAAGAC
ATGGATATCCTGATGGAACGAAACCTTCGAACTCCAAACCTGCTCGCATTCGTAAGGGCTGTCAAG
CACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAA
CTGACGTTCTATCTGGTTACCCTTGAGCAAGCGCAGGAACAACAG SEQ ID NO:229
pMON35725.seq GCCACCAACATCTCCCGCCTCCTGCAGGAGACCTCCGAGCAGCTGGTGGCGCTGAAGCCCTGGATC
ACTCGCCAGAACTTCTCCCGGTGCCTGGAGCTGCAGTGTCAGCCCGACTCCTCAACCCTGGGCGGT
GGGTCAGGAGGTGGGTCAGGAGGTGGATCCGGAGGTGGCACCCAGGACTGCTCCTTCCAACACAGC
CCCATCTCCTCCGACTTYGCTGTCAAAATCCGTGAGCTGTCTGACTACCTGCTTCAAGATTACCCA
GTCACCGTGGCCTCCAACCTGCAGGACGAGGAGCTCTGCGGGGGCCTCTGGCGGCTGGTCCTGGCA
CAGCGCTGGATGGAGCGGCTCAAGACTGTCGCTGGGTCCAAGATGCAAGGCTTGCTGGAGCGCGTG
AACACGGAGATACACTTTGTCACCAAATGTGCCTTTCAGCCCCCCCCAGCTGTCTTCGCTTCGTC
CAGTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTAACTGCTCTATAATGATCGATGAA
ATTATACATCACTTAAAGAGACCACCTAACCCTTTGCTGGACCCGAACAACCTCAATTCTGAAGAC
ATGGATATCCTGATGGAACGAAACCTTCGAACTCCAAACCTGCTCGCATTCGTAAGGGCTGTCAAG
CACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAA
CTGACGTTCTATCTGGTTACCCTTGAGCAAGCGCAGGAACAACAG SEQ ID NO:230

| TABLE 2-continued |
|---|
| GENE SEQUENCES | pMON35726.seq

GCCCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCAGCCCGACTCCTCA
ACCCTGGGCGGTGGGTCAGGAGGTGGGTCAGGAGGTGGATCCGGAGGTGGCACCCAGGACTGCTCC
TTCCAACACAGCCCCATCTCCTCCGACTTCGCTGTCAAAATCCGTGAGCTGTCTGACTACCTGCTT
CAAGATTACCCAGTCACCGTGGCCTCCAACCTGCAGGACGAGGAGCTCTGCGGGGGCCTCTGGCGG
CTGGTCCTGGCACAGCGCTGGATGGAGCGGCTCAAGACTGTCGCTGGGTCCAAGATGCAAGGCTTG
CTGGAACGCGTGAACACGGAGATACACTTTGTCACCAAATGTGCCTTTCAGCCCCCCCCCAGCTGT
TTTTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTAACTGCTCTATAATGATCGATGAA
ATTATACATCACTTAAAGAGACCACCTAACCCTTTGCTGGACCCGAACAACCTCAATTCTGAAGAC
ATGGATATCCTGATGGAACGAAACCTTCGAACTCCAAACCTGCTCGCATTCGTAAGGGCTGTCAAG
CACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAA
CTGACGTTCTATCTGGTTACCCTTGAGCAAGCGCAGGAACAACAG SEQ ID NO:231 pMON35744.seq

GCTTCAAATCTGCAGGATGAAGAGCTGTGCGGGGGCCTCTGGCGGCTGGTCCTGGCACAGCGCTGG
ATGGAGCGGCTCAAGACTGTCGCTGGGTCCAAGATGCAAGGCTTGCTGGAGCGCGTGAACACGGAG
ATACACTTTGTCACCAAATGTGCCTTTCAGCCCCCCCCCAGCTGTCTTCGCTTCGTCCAGACCAAC
ATCTCCCGCCTCCTGCAGGAGACCTCCGAGCAGCTGGTGGCGCTGAAGCCCTGGATCACTCGCCAG
AACTTCTCCCGGTGCCTGGAGCTGCAGTGTCAGCCCGACTCCTCAACCCTGGGCGGTGGGTCAGGA
GGTGGGTCAGGAGGTGGATCCGGAGGTGGCTCAGGGGAGGTAGTGGTACCCAGGACTGCTCCTTC
CAACACAGCCCCATCTCCTCCGACTTCGCTGTCAAAATCCGTGAGCTGTCTGACTACCTGCTTCAA
GATTACCCAGTCACCGTGGCCTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTAACTGC
TCTATAATGATCGATGAAATTATACATCACTTAAAGAGACCACCTAACCCTTTGCTGGACCCGAAC
AACCTCAATTCTGAAGACATGGATATCCTGATGGAACGAAACCTTCGAACTCCAAACCTGCTCGCA
TTCGTAAGGGCTGTCAAGCACTTAGAAAATGCATCAGGTATTGAGGCAATTCTTCGTAATCTCCAA
CCATGTCTGCCCTCTGCCACGGCCGCACCCTCTCGACATCCAATCATCATCAAGGCAGGTGACTGG
CAAGAATTCCGGGAAAAACTGACGTTCTATCTGGTTACCCTTGAGCAAGCGCAGGAACAACAG
SEQ ID NO:232 pMON35745.seq

GCTAATCTGCAAGATGAGGAGCTGTGCGGGGGCCTCTGGCGGCTGGTCCTGGCACAGCGCTGGATG
GAGCGGCTCAAGACTGTCGCTGGGTCCAAGATGCAAGGCTTGCTGGAGCGCGTGAACACGGAGATA
CACTTTGTCACCAAATGTGCCTTTCAGCCCCCCCCCAGCTGTCTTCGCTTCGTCCAGACCAACATC
TCCCGCCTCCTGCAGGAGACCTCCGAGCAGCTGGTGGCGCTGAAGCCCTGGATCACTCGCCAGAAC
TTCTCCCGGTGCCTGGAGCTGCAGTGTCAGCCCGACTCCTCAACCCTGGGCGGTGGGTCAGGAGGT
GGGTCAGGAGGTGGATCCGGAGGTGGCTCAGGGGAGGTAGTGGTACCCAGGACTGCTCCTTCCAA
CACAGCCCCATCTCCTCCGACTTCGCTGTCAAAATCCGTGAGCTGTCTGACTACCTGCTTCAAGAT
TACCCAGTCACCGTGGCCTCCTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTAACTGC
TCTATAATGATCGATGAAATTATACATCACTTAAAGAGACCACCTAACCCTTTGCTGGACCCGAAC
AACCTCAATTCTGAAGACATGGATATCCTGATGGAACGAAACCTTCGAACTCCAAACCTGCTCGCA
TTCGTAAGGGCTGTCAAGCACTTAGAAAATGCATCAGGTATTGAGGCAATTCTTCGTAATCTCCAA
CCATGTCTGCCCTCTGCCACGGCCGCACCCTCTCGACATCCAATCATCATCAAGGCAGGTGACTGG
CAAGAATTCCGGGAAAAACTGACGTTCTATCTGGTTACCCTTGAGCAAGCGCAGGAACAACAG
SEQ ID NO:233 pMON35746.seq

GCGCTGCAGGATGAAGAGCTGTGTGGCGGCCTCTGGCGCCTGGTCCTGGCACAGCGCTTGATGGAG
CGGCTCAAGACTGTCGCTGGGTCCAAGATGCAAGGCTTGCTGGAGCGCGTGAACACGGAGATACAC
TTTGTCACCAAATGTGCCTTTCAGCCCCCCCCCAGCTGTCTTCGCTTCGTCCAGACCAACATCTCC
CGCCTCCTGCAGGAGACCTCCGAGCAGCTGGTGGCGCTGAAGCCCTGGATCACTCGCCAGAACTTC
TCCCGGTGCCTGGAGCTGCAGTGTCAGCCCGACTCCTCAACCCTGGGCGGTGGGTCAGGAGGTGGG
TCAGGAGGTGGATCCGGAGGTGGCTCAGGGGAGGTAGTGGTACCCAGGACTGCTCCTTCCAACAC
AGCCCCATCTCCTCCGACTTCGCTGTCAAAATCCGTGAGCTGTCTGACTACCTGCTTCAAGATTAC
CCAGTCACCGTGGCCTCCAACTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTAACTGC
TCTATAATGATCGATGAAATTATACATCACTTAAAGAGACCACCTAACCCTTTGCTGGACCCGAAC
AACCTCAATTCTGAAGACATGGATATCCTGATGGAACGAAACCTTCGAACTCCAAACCTGCTCGCA
TTCGTAAGGGCTGTCAAGCACTTAGAAAATGCATCAGGTATTGAGGCAATTCTTCGTAATCTCCAA
CCATGTCTGCCCTCTGCCACGGCCGCACCCTCTCGACATCCAATCATCATCAAGGCAGGTGACTGG
CAAGAATTCCGGGAAAAACTGACGTTCTATCTGGTTACCCTTGAGCAAGCGCAGGAACAACAG
SEQ ID NO:234 pMON35747.seq

GCGCAAGATGAGGAACTGTGTGGTGGTCTCTGGCGGCTGGTCCTGGCACAGCGCTGGATGGAGCGG
CTCAAGACTGTCGCTGGGTCCAAGATGCAAGGCTTGCTGGAGCGCGTGAACACGGAGATACACTTT
GTCACCAAATGTGCCTTTCAGCCCCCCCCCAGCTGTCTTCGCTTCGTCCAGACCAACATCTCCCGC
CTCCTGCAGGAGACCTCCGAGCAGCTGGTGGCGCTGAAGCCCTGGATCACTCGCCAGAACTTCTCT
CGGTGCCTGGAGCTGCAGTGTCAGCCCGACTCCTCAACCCTGGGCGGTGGGTCAGGAGGTGGGTCA
GGAGGTGGATCCGGAGGTGGCTCAGGGGAGGTAGTGGTACCCAGGACTGCTCCTTCCAACACAGC
CCCATCTCCTCCGACTTCGCTGTCAAAATCCGTGAGCTGTCTGACTACCTGCTTCAAGATTACCCA
GTCACCGTGGCCTCCAACCTGTACGTAGAGGGCGGTGGAGGCTCCCCGGGTGAACCGTCTGGTCCA

TABLE 2-continued

GENE SEQUENCES

ATCTCTACTATCAACCCGTCTCCCCCGTCTAAAGAATCTCATAAATCTCCAAACATGGCTAACTGC
TCTATAATGATCGATGAAATTATACATCACTTAAAGAGACCACCTAACCCTTTGCTGGACCCGAAC
AACCTCAATTCTGAAGACATGGATATCCTGATGGAACGAAACCTTCGAACTCCAAACCTGCTCGCA
TTCGTAAGGGCTGTCAAGCACTTAGAAAATGCATCAGGTATTGAGGCAATTCTTCGTAATCTCCAA
CCATGTCTGCCCTCTGCCACGGCCGCACCCTCTCGACATCCAATCATCATCAAGGCAGGTGACTGG
CAAGAATTCCGGGAAAAACTGACGTTCTATCTGGTTACCCTTGAGCAAGCGCAGGAACAACAG
SEQ ID NO:235
pMON35748.seq GCTGAAGAACTGTGTGGTGGCCTGTGGCGGCTGGTCCTGGCACAGCGCTGGATGGAGCGGCTCAAG
ACTGTCGCTGGGTCCAAGATGCAAGGCTTGCTGGAGCGCGTGAACACGGAGATACACTTTGTCACC
AAATGTGCCTTTCAGCCCCCCCCAGCTGTCTTCGCTTCGTCCAGACCAACATCTCCCGCCTCCTG
CAGGAGACCTCCGAGCAGCTGGTGGCGCTGAAGCCCTGGATCACTCGCCAGAACTTCTCCCGGTGC
CTGGAGCTGCAGTGTCAGCCCGACTCCTCAACCCTGGGCGGTGGGTCAGGAGGTGGGTCAGGAGGT
GGATCCGGAGGTGGCTCAGGGGGAGGTAGTGGTACCCAGGACTGCTCCTTCCAACACAGCCCCATC
TCCTCCGACTTCGCTGTCAAAATCCGTGAGCTGTCTGACTACCTGCTTCAAGATTACCCAGTCACC
GTGGCCTCCAACCTGCAGGACTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTAACTGC
TCTATAATGATCGATGAAATTATACATCACTTAAAGAGACCACCTAACCCTTTGCTGGACCCGAAC
AACCTCAATTCTGAAGACATGGATATCCTGATGGAACGAAACCTTCGAACTCCAAACCTGCTCGCA
TTCGTAAGGGCTGTCAAGCACTTAGAAAATGCATCAGGTATTGAGGCAATTCTTCGTAATCTCCAA
CCATGTCTGCCCTCTGCCACGGCCGCACCCTCTCGACATCCAATCATCATCAAGGCAGGTGACTGG
CAAGAATTCCGGGAAAAACTGACGTTCTATCTGGTTACCCTTGAGCAAGCGCAGGAACAACAG
SEQ ID NO:236
pMON35749.seq GCTCTGTGCGGTGGCCTGTGGCGTCTGGTCCTGGCACAGCGCTGGATGGAGCGGCTCAAGACTGTC
GCTGGGTCCAAGATGCAAGGCTTGCTGGAGCGCGTGAACACGGAGATACACTTTGTCACCAAATGT
GCCTTTCAGCCCCCCCCAGCTGTCTTCGCTTCGTCCAGACCAACATCTCCCGCCTCCTGCAGGAG
ACCTCCGAGCAGCTGGTGGCGCTGAAGCCCTGGATCACTCGCCAGAACTTCTCCCGGTGCCTGGAG
CTGCAGTGTCAGCCCGACTCCTCAACCCTGGGCGGTGGGTCAGGAGGTGGGTCAGGAGGTGGATCC
GGAGGTGGCTCAGGGGGAGGTAGTGGTACCCAGGACTGCTCCTTCCAACACAGCCCCATCTCCTCC
GACTTCGCTGTCAAAATCCGTGAGCTGTCTGACTACCTGCTTCAAGATTACCCAGTCACCGTGGCC
TCCAACCTGCAGGACGAGGAGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTAACTGC
TCTATAATGATCGATGAAATTATACATCACTTAAAGAGACCACCTAACCCTTTGCTGGACCCGAAC
AACCTCAATTCTGAAGACATGGATATCCTGATGGAACGAAACCTTCGAACTCCAAACCTGCTCGCA
TTCGTAAGGGCTGTCAAGCACTTAGAAAATGCATCAGGTATTGAGGCAATTCTTCGTAATCTCCAA
CCATGTCTGCCCTCTGCCACGGCCGCACCCTCTCGACATCCAATCATCATCAAGGCAGGTGACTGG
CAAGAATTCCGGGAAAAACTGACGTTCTATCTGGTTACCCTTGAGCAAGCGCAGGAACAACAG
SEQ ID NO:237
pMON35750.seq GCACTGTGTGGTGGTCTGTGGCGTCTGGTCCTGGCACAGCGCTGGATGGAGCGGCTCAAGACTGTC
GCTGGGTCCAAGATGCAAGGCTTGCTGGAGCGCGTGAACACGGAGATACACTTTGTCACCAAATGT
GCCTTTCAGCCCCCCCCAGCTGTCTTCGCTTCGTCCAGACCAACATCTCCCGCCTCCTGCAGGAG
ACCTCCGAGCAGCTGGTGGCGCTGAAGCCCTGGATCACTCGCCAGAACTTCTCCCGGTGCCTGGAG
CTGCAGTGTCAGCCCGACTCCTCAACCCTGGGCGGTGGGTCAGGAGGTGGGTCAGGAGGTGGATCC
GGAGGTGGCTCAGGGGGAGGTAGTGGTACCCAGGACTGCTCCTTCCAACACAGCCCCATCTCCTCC
GACTTCGCTGTCAAAATCCGTGAGCTGTCTGACTACCTGCTTCAAGATTACCCAGTCACCGTGGCC
TCCAACCTGCAGGACGAGGAGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTAACTGC
TCTATAATGATCGATGAAATTATACATCACTTAAAGAGACCACCTAACCCTTTGCTGGACCCGAAC
AACCTCAATTCTGAAGACATGGATATCCTGATGGAACGAAACCTTCGAACTCCAAACCTGCTCGCA
TTCGTAAGGGCTGTCAAGCACTTAGAAAATGCATCAGGTATTGAGGCAATTCTTCGTAATCTCCAA
CCATGTCTGCCCTCTGCCACGGCCGCACCCTCTCGACATCCAATCATCATCAAGGCAGGTGACTGG
CAAGAATTCCGGGAAAAACTGACGTTCTATCTGGTTACCCTTGAGCAAGCGCAGGAACAACAG
SEQ ID NO:238
pMON35769.seq GCTCTGTGTGGCGGTCTGTGGCGTCTGGTCCTGGCACAGCGCTGGATGGAGCGGCTCAAGACTGTC
GCTGGGTCCAAGATGCAAGGCTTGCTGGAGCGCGTGAACACGGAGATACACTTTGTCACCAAATGT
GCCTTTCAGCCCCCCCCAGCTGTCTTCGCTTCGTCCAGACCAACATCTCCCGCCTCCTGCAGGAG
ACCCGAGCAGCTGGTGGCGCTGAAGCCCTGGATCACTCGCCAGAACTTCTCCCGGTGCCTGGAG
CTGCAGTGTCGGCCCGACTCCTCAACCCTGGGCGGTGGGTCAGGAGGTGGGTCAGGAGGTGGATCC
GGAGGTGGCTCAGGGGGAGGTAGTGGTACCCAGGACTGCTCCTTCCAACACAGCCCCATCTCCTCC
GACTTCGCTGTCAAGATCCGTGAGCTGTCTGACTACCTGCTTCAAGATTACCCAGTCACCGTGGCC
TCCAACCTGCAGGACGAGGAGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTAACTGC
TCTATAATGATCGATGAAATTATACATCACTTAAAGAGACCACCTAACCCTTTGCTGGACCCGAAC
AACCTCAATTCTGAAGACATGGATATCCTGATGGAACGAAACCTTCGAACTCCAAACCTGCTCGCA
TTCGTAAGGGCTGTCAAGCACTTAGAAAATGCATCAGGTATTGAGGCAATTCTTCGTAATCTCCAA
CCATGTCTGCCCTCTGCCACGGCCGCACCCTCTCGACATCCAATCATCATCAAGGCAGGTGACTGG
CAAGAATTCCGGGAAAAACTGACGTTCTATCTGGTTACCCTTGAGCAAGCGCAGGAACAACAG
SEQ ID NO:239

TABLE 2-continued

GENE SEQUENCES pMON35771.seq

```
GCCTCCAAGATGCAAGGCTTGCTGGAGCGCGTGAACACGGAGATACACTTTGTCACCAAATGTGCC
TTTCAGCCCCCCCCAGCTGTCTTCGCTTCGTCCAGACCAACATCTCCCGCCTCCTGCAGGAGACC
TCCGAGCAGCTGGTGGCGCTGAAGCCCTGGATCACTCGCCAGAACTTCTCCCGGTGCCTGGAGCTG
CAGTGTCAGCCCGACTCCTCAACCCTGGGCGGTGGGTCAGGAGGTGGGTCAGGAGGTGGATCCGGA
GGTGGCACCCAGGACTGCTCCTTCCAACACAGCCCCATCTCCTCCGACTTCGCTGTCAAAATCCGT
GAGCTGTCTGACTACCTGCTTCAAGATTACCCAGTCACCGTGGCCTCCAACCTGCAGGACGAGGAG
CTCTGCGGGGGCCTCTGGCGGCTGGTCCTGGCACAGCGCTGGATGGAGCGGCTCAAGACTGTCGCT
GGCTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTAACTGCTCTATAATGATCGATGAA
ATTATACATCACTTAAAGAGACCACCTAACCCTTTGCTGGACCCGAACAACCTCAATTCTGAAGAC
ATGGATATCCTGATGGAACGAAACCTTCGAACTCCAAACCTGCTCGCATTCGTAAGGGCTGTCAAG
CACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAA
CTGACGTTCTATCTGGTTACCCTTGAGCAAGCGCAGGAACAACAG SEQ ID NO:240
``` pMON35774.seq

```
GCTCAAGATGATGAGCTGTGTGGTGGTCTCTGGCGGCTGGTCCTGGCACAGCGCTGGATGGAGCGG
CTCAAGACTGTCGCTGGGTCCAAGATGCAAGGCTTGCTGGAGCGCGTGAACACGGAGATACACTTT
GTCACCAAATGTGCCTTTCAGCCCCCCCCAGCTGTCTTCGCTTCGTCCAGACCAACATCTCCCGC
CTCCTGCAGGAGACCTCCGAGCAGCTGGTGGCGCTGAAGCCCTGGATCACTCGCCAGAACTTCTCC
CGGTGCCTGGAGCTGCAGTGTCAGCCCGACTCCTCAACCCTGGGCGGTGGGTCAGGAGGTGGGTCA
GGCGGTGGTTCTGGCGGAGGATCCGGCGGCGGAAGCGGAGGTGGCTCTGGGGGAGGTAGTGGTACC
CAGGACTGCTCCTTCCAACACAGCCCCATCTCCTCCGACTTCGCTGTCAAAATCCGTGAGCTGTCT
GACTACCTGCTTCAAGATTACCCAGTCACCGTGGCCTCCAACCTGTACGTAGAGGGCGGTGGAGGC
TCCCCGGGTGAACCGTCTGGTCCAATCTCTACTATCAACCCGTCTCCTCCGTCTAAAGAATCTCAT
AAATCTCCAAACATGGCTAACTGCTCTATAATGATCGATGAAATTATACATCACTTAAAGAGACCA
CCTAACCCTTTGCTGGACCCGAACAACCTCAATTCTGAAGACATGGATATCCTGATGGAACGAAAC
CTTCGAACTCCAAACCTGCTCGCATTCGTAAGGGCTGTCAAGCACTTAGAAAATGCATCAGGTATT
GAGGCAATTCTTCGTAATCTCCAACCATGTCTGCCCTCTGCCACGGCCGCACCCTCTCGACATCCA
ATCATCATCAAGGCAGGTGACTGGCAAGAATTCCGGGAAAAACTGACGTTCTATCTGGTTACCCTT
GAGCAAGCGCAGGAACAACAG SEQ ID NO:241
``` pMON35775.seq

```
GCCCAAGATGAAGAACTGTGTGGTGGCCTCTGGCGGCTGGTCCTGGCACAGCGCTGGATGGAGCGG
CTCAAGACTGTCGCTGGGTCCAAGATGCAAGGCTTGCTGGAGCGCGTGAACACGGAGATACACTTT
GTCACCAAATGTGCCTTTCAGCCCCCCCCAGCTGTCTTCGCTTCGTCCAGACCAACATCTCCCGC
CTCCTGCAGGAGACCTCCGAGCAGCTGGTGGCGCTGAAGCCCTGGATCACTCGCCAGAACTTCTCC
CGGTGCCTGGAGCTGCAGTGTCAGCCCGACTCCTCAACCCTGCCGCCACCGTGGAGCCCGCGTCCA
CTCGGCGCCACCGCACCGACCACCCAGGACTGCTCCTTCCAACACAGCCCCATCTCCTCCGACTTC
GCTGTCAAAATCCGTGAGCTGTCTGACTACCTGCTTCAAGATTACCCAGTCACCGTGGCCTCCAAC
CTGTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTAACTGCTCTATAATGATCGATGAA
ATTATACATCACTTAAAGAGACCACCTAACCCTTTGCTGGACCCGAACAACCTCAATTCTGAAGAC
ATGGATATCCTGATGGAACGAAACCTTCGAACTCCAAACCTGCTCGCATTCGTAAGGGCTGTCAAG
CACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCCGGGAAAAA
CTGACGTTCTATCTGGTTACCCTTGAGCAAGCGCAGGAACAACAG SEQ ID NO:242
``` pMON35776.seq

```
GCCCAAGATGAAGAACTGTGTGGTGGCCTCTGGCGGCTGGTCCTGGCACAGCGCTGGATGGAGCGG
CTCAAGACTGTCGCTGGGTCCAAGATGCAAGGCTTGCTGGAGCGCGTGAACACGGAGATACACTTT
GTCACCAAATGTGCCTTTCAGCCCCCCCCAGCTGTCTTCGCTTCGTCCAGACCAACATCTCCCGC
CTCCTGCAGGAGACCTCCGAGCAGCTGGTGGCGCTGAAGCCCTGGATCACTCGCCAGAACTTCTCC
CGGTGCCTGGAGCTGCAGTGTCAGCCCGACTCCTCAACCCTGCCGCCACCGTGGAGCCCGCGTCCA
CTCGGCGCCACCGCACCGACCGCTGGACAACGCCTCTGACCCAGGACTGCTCCTTCCAACACAGC
CCCATCTCCTCCGACTTCGCTGTCAAAATCCGTGAGCTGTCTGACTACCTGCTTCAAGATTACCCA
GTCACCGTGGCCTCCAACCTGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTAACTGC
TCTATAATGATCGATGAAATTATACATCACTTAAAGAGACCACCTAACCCTTTGCTGGACCCGAAC
AACCTCAATTCTGAAGACATGGATATCCTGATGGAACGAAACCTTCGAACTCCAAACCTGCTCGCA
TTCGTAAGGGCTGTCAAGCACTTAGAAAATGCATCAGGTATTGAGGCAATTCTTCGTAATCTCCAA
CCATGTCTGCCCTCTGCCACGGCCGCACCCTCTCGACATCCAATCATCATCAAGGCAGGTGACTGG
CAAGAATTCCGGGAAAAACTGACGTTCTATCTGGTTACCCTTGAGCAAGCGCAGGAACAACAG
SEQ ID NO:243
``` pMON32169.seq/pMON40000.seq

```
GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCCGCAGCCCTAC
GTAGAGGGCGGTGGAGGCTCCCCGGGTGAACCGTCTGGTCCAATCTCTACTATCAACCCGTCTCCT
```

TABLE 2-continued

GENE SEQUENCES

CCGTCTAAAGAATCTCATAAATCTCCAAACATGGCTGATGAAGAACTGTGTGGTGGTCTGTGGCGG
CTGGTCCTGGCACAGCGCTGGATGGAGCGGCTCAAGACTGTCGCTGGGTCCAAGATGCAAGGCTTG
CTGGAGCGCGTGAACACGGAGATACACTTTGTCACCAAATGTGCCTTTCAGCCCCCCCCCAGCTGT
CTTCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCAGCCCGACTCCTCA
ACCCTGGGCGGTGGGTCAGGAGGTGGGTCAGGAGGTGGATCCGGAGGTGGCTCAGGGGGAGGTAGT
GGTACCCAGGACTGCTCCTTCCAACACAGCCCCATCTCCTCCGACTTCGCTGTCAAAATCCGTGAG
CTGTCTGACTACCTGCTTCAAGATTACCCAGTCACCGTGGCCTCCAACCTGCAG SEQ ID
NO:244
pMON32188.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCAAATCTGCAAGACGAGGAGCTGTGCGGGGGC
CTCTGGCGGCTGGTCCTGGCACAGCGCTGGATGGAGCGGCTCAAGACTGTCGCTGGGTCAAGATG
CAAGGCTTGCTGGAGCGCGTGAACACGGAGATACACTTTGTCACCAAATGTGCCTTTCAGCCCCC
CCCAGCTGTCTTCGCTTCGTCCAGATCAACATCTCCCGCCTCCTGCAGGAGACCTCCGAGCAGCTG
GTGGCGCTGAAGCCCTGGATCACTCGCCAGAACTTCTCCCGGTGCCTGGAGCTGCAGTGTCAGCCC
GACTCCTCAACCCTGGGCGGTGGGTCAGGAGGTGGGTCAGGAGGTGGATCCGGAGGTGGCTCAGGG
GGAGGTAGTGGTACCCAGGACTGCTCCTTCCAACACAGCCCCATCTCCTCCGACTTCGCTGTCAAA
ATCCGTGAGCTGTCTGACTACCTGCTTCAAGATTACCCAGTCACCGTGGCCTCC SEQ ID
NO:245
pMON32273.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCCCCCCCAGCTGTCTTCGCTTCGTCCAGACC
AACATCTCCCGCCTCCTGCAGGAGACCTCCGAGCAGCTGGTGGCGCTGAAGCCCTGGATCACTCGC
CAGAACTTCTCCCGGTGCCTGGAGCTGCAGTGTCAGCCCGACTCCTCAACCCTGGGCGGTGGGTCA
GGAGGTGGGTCAGGAGGTGGATCCGGAGGTGGCTCAGGGGGAGGTAGTGGTACCCAGGACTGCTCC
TTCCAACACAGCCCCATCTCCTCCGACTTCGCTGTCAAAATCCGTGAGCTGTCTGACTACCTGCTT
CAAGATTACCCAGTCACCGTGGCCTCCAACCTGCAGGACGAGGAGCTCTGCGGGGCCTCTGGCGG
CTGGTCCTGGCACAGCGCTGGATGGAGCGGCTCAAGACTGTCGCTGGGTCCAAGATGCAAGGCTTG
CTGGAGCGCGTGAACACGGAGATACACTTTGTCACCAAATGTGCCTTTCAGCCC SEQ ID
NO:246
pMON35795.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCTCTGCAGGATGAGGAACTGTGCGGCGGCCTC
TGGCGGCTGGTCCTGGCACAGCGCTGGATGGAGCGGCTCAAGACTGTCGCTGGGTCCAAGATGCAA
GGCTTGCTGGAGCGCGTGAACACGGAGATACACTTTGTCACCAAATGTGCCTTTCAGCCCCCCCCC
AGCTGTCTTCGCTTCGTCCAGACCAACATCTCCCGCCTCCTGCAGGAGACCTCCGAGCAGCTGGTG
GCGCTGAAGCCCTGGATCACTCGCCAGAACTTCTCCCGGTGCCTGGAGCTGCAGTGTCAGCCCGAC
TCCTCAACCCTGGGCGGTGGGTCAGGAGGTGGGTCAGGAGGTGGATCCGGAGGTGGCTCAGGGGGA
GGTAGTGGTACCCAGGACTGCTCCTTCCAACACAGCCCCATCTCCTCCGACTTCGCTGTCAAAATC
CGTGAGCTGTCTGACTACCTGCTTCAAGATTACCCAGTCACCGTGGCCTCCAAC SEQ ID
NO:247
pMON35796.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG

TABLE 2-continued

GENE SEQUENCES

CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCTCAAGATGAAGAGCTGTGTGGTGGTCTCTGG
CGGCTGGTCCTGGCACAGCGCTGGATGGAGCGGCTCAAGACTGTCGCTGGGTCCAAGATGCAAGGC
TTGCTGGAGCGCGTGAACACGGAGATACACTTTGTCACCAAATGTGCCTTTCAGCCCCCCCCAGC
TGTCTTCGCTTCGTCCAGACCAACATCTCCCGCCTCCTGCAGGAGACCTCCGAGCAGCTGGTGGCG
CTGAAGCCCTGGATCACTCGCCAGAACTTCTCCCGGTGCCTGGAGCTGCAGTGTCAGCCCGACTCC
TCAACCCTGGGCGGTGGGTCAGGAGGTGGGTCAGGAGGTGGATCCGGAGGTGGCTCAGGGGGAGGT
AGTGGTACCCAGGACTGCTCCTTCCAACACAGCCCCATCTCCTCCGACTTCGCTGTCAAAATCCGT
GAGCTGTCTGACTACCTGCTTCAAGATTACCCAGTCACCGTGGCCTCCAACCTG SEQ ID
NO:248
pMON35797.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCTGAAGAACTGTGTGGTGGTCTGTGGCGGCTG
GTCCTGGCACAGCGCTGGATGGAGCGGCTCAAGACTGTCGCTGGGTCCAAGATGCAAGGCTTGCTG
GAGCGCGTGAACACGGAGATACACTTTGTCACCAAATGTGCCTTTCAGCCCCCCCCCAGCTGTCTT
CGCTTCGTCCAGACCAACATCTCCCGCCTCCTGCAGGAGACCTCCGAGCAGCTGGTGGCGCTGAAG
CCCTGGATCACTCGCCAGAACTTCTCCCGGTGCCTGGAGCTGCAGTGTCAGCCCGACTCCTCAACC
CTGGGCGGTGGGTCAGGAGGTGGGTCAGGAGGTGGATCCGGAGGTGGCTCAGGGGGAGGTAGTGGT
ACCCAGGACTGCTCCTTCCAACACAGCCCCATCTCCTCCGACTTCGCTGTCAAAATCCGTGAGCTG
TCTGACTACCTGCTTCAAGATTACCCAGTCACCGTGGCCTCCAACCTGCAGGAC SEQ ID
NO:249
pMON35798.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCTGAGCTGTGTGGTGGCCTGTGGCGTCTGGTC
CTGGCACAGCGCTGGATGGAGCGGCTCAAGACTGTCGCTGGGTCCAAGATGCAAGGCTTGCTGGAG
CGCGTGAACACGGAGATACACTTTGTCACCAAATGTGCCTTTCAGCCCCCCCCCAGCTGTCTTCGC
TTCGTCCAGACCAACATCTCCCGCCTCCTGCAGGAGACCTCCGAGCAGCTGGTGGCGCTGAAGCCC
TGGATCACTCGCCAGAACTTCTCCCGGTGCCTGGAGCTGCAGTGTCAGCCCGACTCCTCAACCCTG
GGCGGTGGGTCAGGAGGTGGGTCAGGAGGTGGATCCGGAGGTGGCTCAGGGGGAGGTAGTGGTACC
CAGGACTGCTCCTTCCAACACAGCCCCATCTCCTCCGACTTCGCTGTCAAAATCCGTGAGCTGTCT
GACTACCTGCTTCAAGATTACCCAGTCACCGTGGCCTCCAACCTGCAGGACGAG SEQ ID
NO:250
pMON35799.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCTCTGTGGTGGTCTGTGGCGTCTGGTCCTG
GCACAGCGCTGGATGGAGCGGCTCAAGACTGTCGCTGGGTCCAAGATGCAAGGCTTGCTGGAGCGC
GTGAACACGGAGATACACTTTGTCACCAAATGTGCCTTTCAGCCCCCCCCAGCTGTCTTCGCTTC
GTCCAGACCAACATCTCCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGACTCCTCAACCCTGGGC
GGTGGGTCAGGAGGTGGGTCAGGAGGTGGATCCGGAGGTGGCTCAGGGGGAGGTAGTGGTACCCAG
GACTGCTCCTTCCAACACAGCCCCATCTCCTCCGACTTCGCTGTCAAAATCCGTGAGCTGTCTGAC
TACCTGCTTCAAGATTACCCAGTCACCGTGGCCTCCAACCTGCAGGACGAGGAG SEQ ID
NO:251
pMON39914.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC TABLE 2-continued

GENE SEQUENCES

AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCTGATGAAGAACTGTGTGGTGGGCTGTGGCGG
CTGGTCCTGGCACAGCGCTGGATGGAGCGGCTCAAGACTGTCGCTGGGTCCAAGATGCAAGGCTTG
CTGGAGCGCGTGAACACGGAGATACACTTTGTCACCAAATGTGCCTTTCAGCCCCCCCCAGCTGT
CTTCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCAGCCCGACTCCTCA
ACCCTGCCGCCACCGTGGAGCCCGCGTCCACTCGGCGCCACCGCACCGACCACCCAGGACTGCTCC
TTCCAACACAGCCCCATCTCCTCCGACTTCGCTGTCAAAATCCGTGAGCTGTCTGACTACCTGCTT
CAAGATTACCCAGTCACCGTGGCCTCCAACCTGCAG    SEQ ID NO:252
pMON39915.seq GCTACACCATTGGGC.CCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCTGATGAAGAACTGTGTGGTGGGCTGTGGCGG
CTGGTCCTGGCACAGCGCTGGATGGAGCGGCTCAAGACTGTCGCTGGGTCCAAGATGCAAGGCTTG
CTGGAGCGCGTGAACACGGAGATACACTTTGTCACCAAATGTGCCTTTCAGCCCCCCCCAGCTGT
CTTCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCAGCCCGACTCCTCA
ACCCTGGGCGGTGGGTCAGGAGGTGGGTCAGGCGGTGGTTCTGGCGGAGGATCCGGCGGCGGAAGC
GGAGGTGGCTCTGGGGGAGGTAGTGGTACCCAGGACTGCTCCTTCCAACACAGCCCCATCTCCTCC
GACTTCGCTGTCAAAATCCGTGAGCTGTCTGACTACCTGCTTCAAGATTACCCAGTCACCGTGGCC
TCCAACCTGCAG    SEQ ID NO:253
pMON39916.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCTGATGAAGAACTGTGTGGTGGGCTGTGGCGG
CTGGTCCTGGCACAGCGCTGGATGGAGCGGCTCAAGACTGTCGCTGGGTCCAAGATGCAAGGCTTG
CTGGAGCGCGTGAACACGGAGATACACTTTGTCACCAAATGTGCCTTTCAGCCCCCCCCAGCTGT
CTTCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCAGCCCGACTCCTCA
ACCCTGCCGCCACCGTGGAGCCCGCGTCCACTCGGCGCCACCGCACCGACCGCTGGACAACCGCCT
CTGACCCAGGACTGCTCCTTCCAACACAGCCCCATCTCCTCCGACTTCGCTGTCAAAATCCGTGAG
CTGTCTGACTACCTGCTTCAAGATTACCCAGTCACCGTGGCCTCCAACCTGCAG    SEQ ID
NO:254
pMON35712.seq GCCGATTACCCAGTCACCGTGGCCTCCAACCTGCAGGACGAGGAGCTCTGCGGGGGCCTCTGGCGG
CTGGTCCTGGCACAGCGCTGGATGGAGCGGCTCAAGACTGTCGCTGGGTCCAAGATGCAAGGCTTG
CTGGAGCGCGTGAACACGGAGATACACTTTGTCACCAAATGTGCCTTTCAGCCCCCCCCAGCTGT
CTTCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCAGCCCGACTCCTCA
ACCCTGGGCGGTGGGTCAGGAGGTGGGTCAGGAGGTGGATCCGGAGGTGGCACCCAGGACTGCTCC
TTCCAACACAGCCCCATCTCCTCCGACTTCGCTGTCAAAATCCGTGAGCTGTCTGACTACCTGCTT
CAA    SEQ ID NO:255
pMON35713.seq GCCGCCTCCAACCTGCAGGACGAGGAGCTCTGCGGGGGCCTCTGGCGGCTGGTCCTGGCACAGCGC
TGGATGGAGCGGCTCAAGACTGTCGCTGGGTCCAAGATGCAAGGCTTGCTGGAGCGCGTGAACACG
GAGATACACTTTGTCACCAAATGTGCCTTTCAGCCCCCCCCAGCTGTCTTCGCTTCGTCCAGACC
AACATCTCCCGCCTCCTGCAGGAGACCTCCGAGCAGCTGGTGGCGCTGAAGCCCTGGATCACTCGC
CAGAACTTCTCCCGGTGCCTGGAGCTGCAGTGTCAGCCCGACTCCTCAACCCTGGGCGGTGGGTCA
GGAGGTGGGTCAGGAGGTGGATCCGGAGGTGGCACCCAGGACTGCTCCTTCCAACACAGCCCCATC
TCCTCCGACTTCGCTGTCAAAATCCGTGAGCTGTCTGACTACCTGCTTCAAGATTACCCAGTCACC
GTG    SEQ ID NO:256

TABLE 2-continued

GENE SEQUENCES pMON35714.seq

GCCGTCGCTGGGTCCAAGATGCAAGGCTTGCTGGAGCGCGTGAACACGGAGATACACTTTGTCACC
AAATGTGCCTTTCAGCCCCCCCCCAGCTGTCTTCGCTTCGTCCAGACCAACATCTCCCGCCTCCTG
CAGGAGACCTCCGAGCAGCTGGTGGCGCTGAAGCCCTGGATCACTCGCCAGAACTTCTCCCGGTGC
CTGGAGCTGCAGTGTCAGCCCGACTCCTCAACCCTGGGCGGTGGGTCAGGAGGTGGGTCAGGAGGT
GGATCCGGAGGTGGCACCCAGGACTGCTCCTTCCAACACAGCCCCATCTCCTCCGACTTCGCTGTC
AAAATCCGTGAGCTGTCTGACTACCTGCTTCAAGATTACCCAGTCACCGTGGCCTCCAACCTGCAG
GACGAGGAGCTCTGCGGGGGCCTCTGGCGGCTGGTCCTGGCACAGCGCTGGATGGAGCGGCTCAAG
ACT SEQ ID NO:257 pMON35715.seq

GCCTCCAAGATGCAAGGCTTGCTGGAGCGCGTGAACACGGAGATACACTTTGTCACCAAATGTGCC
TTTCAGCCCCCCCCCAGCTGTCTTCGCTTCGTCCAGACCAACATCTCCCGCCTCCTGCAGGAGACC
TCCGAGCAGCTGGTGGCGCTGAAGCCCTGGATCACTCGCCAGAACTTCTCCCGGTGCCTGGAGCTG
CAGTGTCAGCCCGACTCCTCAACCCTGGGCGGTGGGTCAGGAGGTGGGTCAGGAGGTGGATCCGGA
GGTGGCACCCAGGACTGCTCCTTCCAACACAGCCCCATCTCCTCCGACTTCGCTGTCAAAATCCGT
GAGCTGTCTGACTACCTGCTTCAAGATTACCCAGTCACCGTGGCCTCCAACCTGCAGGACGAGGAG
CTCTGCGGGGGCCTCTGGCGGCTGGTCCTGGCACAGCGCTGGATGGAGCGGCTCAAGACTGTCGCT
GGG SEQ ID NO:258 pMON35716.seq

GCCCCCCCCAGCTGTCTTCGCTTCGTCCAGACCAACATCTCCCGCCTCCTGCAGGAGACCTCCGAG
CAGCTGGTGGCGCTGAAGCCCTGGATCACTCGCCAGAACTTCTCCCGGTGCCTGGAGCTGCAGTGT
CAGCCCGACTCCTCAACCCTGGGCGGTGGGTCAGGAGGTGGGTCAGGAGGTGGATCCGGAGGTGGC
ACCCAGGACTGCTCCTTCCAACACAGCCCCATCTCCTCCGACTTCGCTGTCAAAATCCGTGAGCTG
TCTGACTACCTGCTTCAAGATTACCCAGTCACCGTGGCCTCCAACCTGCAGGACGAGGAGCTCTGC
GGGGGCCTCTGGCGGCTGGTCCTGGCACAGCGCTGGATGGAGCGGCTCAAGACTGTCGCTGGGTCC
AAGATGCAAGGCTTGCTGGAGCGCGTGAACACGGAGATACACTTTGTCACCAAATGTGCCTTTCAG
CCC SEQ ID NO:259 pMON35717.seq

GCCCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCAGCCCGACTCCTCA
ACCCTGGGCGGTGGGTCAQGAGGTGGGTCAGGAGGTGGATCCGGAGGTGGCACCCAGGACTGCTCC
TTCCAACACAGCCCCATCTCCTCCGACTTCGCTGTCAAAATCCGTGAGCTGTCTGACTACCTGCTT
CAAGATTACCCAGTCACCGTGGCCTCCAACCTGCAGGACGAGGAGCTCTGCGGGGGCCTCTGGCGG
CTGGTCCTGGCACAGCGCTGGATGGAGCGGCTCAAGACTGTCGCTGGGTCCAAGATGCAAGGCTTG
CTGGAGCGCGTGAACACGGAGATACACTTTGTCACCAAATGTGCCTTTCAGCCCCCCCCCAGCTGT
CTT SEQ ID NO:260 pMON35718.seq

GCCACCAACATCTCCCGCCTCCTGCAGGAGACCTCCGAGCAGCTGGTGGCGCTGAAGCCCTGGATC
ACTCGCCAGAACTTCTCCCGGTGCCTGGAGCTGCAGTGTCAGCCCGACTCCTCAACCCTGGGCGGT
GGGTCAGGAGGTGGGTCAGGAGGTGGATCCGGAGGTGGCACCCAGGACTGCTCCTTCCAACACAGC
CCCATCTCCTCCGACTTCGCTGTCAAAATCCGTGAGCTGTCTGACTACCTGCTTCAAGATTACCCA
GTCACCGTGGCCTCCAACCTGCAGGACGAGGAGCTCTGCGGGGGCCTCTGGCGGCTGGTCCTGGCA
CAGCGCTGGATGGAGCGGCTCAAGACTGTCGCTGGGTCCAAGATGCAAGGCTTGCTGGAGCGCGTG
AACACGGAGATACACTTTGTCACCAAATGTGCCTTTCAGCCCCCCCCCAGCTGTCTTCGCTTCGTC
CAG SEQ ID NO:261 pMON32170.seq

GCTGATGAAGAACTGTGTGGTGGTCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTACACCA
TTGGGCCCTGCCAGCTCCTGCCCCAGAGCTTCCTGCTCAAGTCTTTAGAGCAAGTGAGAAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCC SEQ ID
NO:262 pMON32187.seq

GCAGATGAAGAACTGTGTGGGGGACTGTGGCGTCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA

TABLE 2-continued

GENE SEQUENCES

GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCGGGCAGGAGGGGTCCTGGTTGCTAGCCAT
CTGCAGAGCTTCCTGGAGGTGTCGTACCGCGTTCTACGCCACCTTGCGCAGCCC SEQ ID
NO:263
pMON32271.seq GCTGATGAAGAACTGTGTGGTGGGCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGCCGCCACCGTGGAGCCCGCGTCCACTC
GGCGCCACCGCACCGACCGCTGGACAACCGCCTCTGACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGTACGTAGAGGGCGGTGGAGGCTCCCCGGGTGGTGGTTCTGGCGGCGGC
TCCAACATGGCTACACCATTGGGCCCTGCCAGCTCCCTGCCCCAGAGCTTCCTGCTCAAGTCTTTA
GAGCAAGTGAGGAAGATCCAGGGCGATGGCGCAGCGCTCCAGGAGAAGCTGTGTGCCACCTACAAG
CTGTGCCACCCCGAGGAGCTGGTGCTGCTCGGACACTCTCTGGGCATCCCCTGGGCTCCCCTGAGC
TCCTGCCCCAGCCAGGCCCTGCAGCTGGCAGGCTGCTTGAGCCAACTCCATAGCGGCCTTTTCCTC
TACCAGGGGCTCCTGCAGGCCCTGGAAGGGATATCCCCCGAGTTGGGTCCCACCTTGGACACACTG
CAGCTGGACGTCGCCGACTTTGCCACCACCATCTGGCAGCAGATGGAAGAACTGGGAATGGCCCCT
GCCCTGCAGCCCACCCAGGGTGCCATGCCGGCCTTCGCCTCTGCTTTCCAGCGCCGGGCAGGAGGG
GTCCTGGTTGCTAGCCATCTGCAGAGCTTCCTGGAGGTGTCGTACCGCGTTCTACGCCACCTTGCG
CAGCCG SEQ ID NO:264
pMON32272.seq GCTGATGAAGAACTGTGTGGTGGGCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGC
GGTGGTTCTGGCGGAGGATCCGGCGGCGGAAGCGGAGGTGGCTCTGGGGGAGGTAGTGGTACCCAG
GACTGCTCCTTCCAACACAGCCCCATCTCCTCCGACTTCGCTGTCAAAATCCGTGAGCTGTCTGAC
TACCTGCTTCAAGATTACCCAGTCACCGTGGCCTCCAACCTGCAGTACGTAGAGGGCGGTGGAGGC
TCCCCGGGTGGTGGTTCTGGCGGCGGCTCCAACATGGCTACACCATTGGGCCCTGCCAGCTCCCTG
CCCCAGAGCTTCCTGCTCAAGTCTTTAGAGCAAGTGAGGAAGATCCAGGGCGATGGCGCAGCGCTC
CAGGAGAAGCTGTGTGCCACCTACAAGCTGTGCCACCCCGAGGAGCTGGTGCTGCTCGGACACTCT
CTGGGCATCCCCTGGGCTCCCCTGAGCTCCTGCCCCAGCCAGGCCCTGCAGCTGGCAGGCTGCTTG
AGCCAACTCCATAGCGGCCTTTTCCTCTACCAGGGGCTCCTGCAGGCCCTGGAAGGGATATCCCCC
GAGTTGGGTCCCACCTTGGACACACTGCAGCTGGACGTCGCCGACTTTGCCACCACCATCTGGCAG
CAGATGGAAGAACTGGGAATGGCCCCTGCCCTGCAGCCCACCCAGGGTGCCATGCCGGCCTTCGCC
TCTGCTTTCCAGCGCCGGGCAGGAGGGGTCCTGGTTGCTAGCCATCTGCAGAGCTTCCTGGAGGTG
TCGTACCGCGTTCTACGCCACCTTGCGCAGCCG SEQ ID NO:265
pMON32274.seq GCTGATGAAGAACTGTGTGGTGGGCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGCCGCCACCGTGGAGCCCGCGTCCACTC
GGCGCCACCGCACCGACCACCCAGGACTGCTCCTTCCAACACAGCCCCATCTCCTCCGACTTCGCT
GTCAAAATCCGTGAGCTGTCTGACTACCTGCTTCAAGATTACCCAGTCACCGTGGCCTCCAACCTG
TACGTAGAGGGCGGTGGAGGCTCCCCGGGTGGTGGTTCTGGCGGCGGCTCCAACATGGCTACACCA
TTGGGCCCTGCCAGCTCCCTGCCCCAGAGCTTCCTGCTCAAGTCTTTAGAGCAAGTGAGRAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCG SEQ ID
NO:266
pMON35751.seq GCGGATGAGGAGCTGTGCGGTGGCCTCTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAGGCCCTGGATCACTCGCCAGAACTTCTCCCGG
TGCCTGGAGCTGCAGTGTCAGCCCGACTCCTCAACCCTGGGCGGTGGGTCAGGAGGTGGATCCGGA

TABLE 2-continued

GENE SEQUENCES

GGTACCCAGGACTGCTCCTTCCAACACAGCCCCATCTCCTCCGACTTCGCTGTCAAAATCCGTGAG
CTGTCTGACTACCTGCTTCAAGATTACCCAGTCACCGTGGCCTCCAACCTGCAGTACGTAGAGGGC
GGTGGAGGCTCCCCGGGTGAACCGTCTGGTCCAATCTCTACTATCAACCCGTCTCCTCCGTCTAAA
GAATCTCATAAATCTCCAAACATGGCTACACCATTAGGCCCTGCCAGCTCCCTGCCCCAGAGCTTC
CTGCTCAAGTGCTTAGAGCAAGTGAGGAAGATCCAGGGCGATGGCGCAGCGCTCCAGGAGAAGCTG
TGTGCCACCTACAAGCTGTGCCACCCCGAGGAGCTGGTGCTGCTCGGACACTCTCTGGGCATCCCC
TGGGCTCCCCTGAGCTCCTGCCCCAGCCAGGCCCTGCAGCTGGCAGGCTGCTTGAGCCAACTCCAT
AGCGGCCTTTTCCTCTACCAGGGGCTCCTGCAGGCCCTGGAAGGGATATCCCCCGAGTTGGGTCCC
ACCTTGGACACACTGCAGCTGGACGTCGCCGACTTTGCCACCACCATCTGGCAGCAGATGGAAGAA
CTGGGAATGGCCCCTGCCCTGCAGCCCACCCAGGGTGCCATGCCGGCCTTCGCCTCTGCTTTCCAG
CGCCGGGCAGGAGGGGTCCTGGTTGCTAGCCATCTGCAGAGCTTCCTGGAGGTGTCGTACCGCGTT
CTACGCCACCTTGCGCAGCCC SEQ ID NO:267
pMON35752.seq GCCGACGAGGAGCTGTGCGGTGGCCTCTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCACCCAGGACTGCTCCTTCCAACACAGCCCCATCTCCTCCGACTTCGCT
GTCAAAATCCGTGAGCTGTCTGACTACCTGCTTCAAGATTACCCAGTCACCGTGGCCTCCAACCTG
CAGTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTACACCATTAGGCCCTGCCAGCTCC
CTGCCCCAGAGCTTCCTGCTCAAGTGCTTAGAGCAAGTGAGGAAGATCCAGGGCGATGGCGCAGCG
CTCCAGGAGAAGCTGTGTGCCACCTACAAGCTGTGCCACCCCGAGGAGCTGGTGCTGCTCGGACAC
TCTCTGGGCATCCCCTGGGCTCCCCTGAGCTCCTGCCCCAGCCAGGCCCTGCAGCTGGCAGGCTGC
TTGAGCCAACTCCATAGCGGCCTTTTCCTCTACCAGGGGCTCCTGCAGGCCCTGGAAGGGATATCC
CCCGAGTTGGGTCCCACCTTGGACACACTGCAGCTGGACGTCGCCGACTTTGCCACCACCATCTGG
CAGCAGATGGAAGAACTGGGAATGGCCCCTGCCCTGCAGCCCACCCAGGGTGCCATGCCGGCCTTC
GCCTCTGCTTTCCAGCGCCGGGCAGGAGGGGTCCTGGTTGCTAGCCATCTGCAGAGCTTCCTGGAG
GTGTCGTACCGCGTTCTACGCCACCTTGCGCAGCCC SEQ ID NO:268
pMON35753.seq GCAGACGAGGAGCTGTGCGGTGGCCTCTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTGTACGCCACCTTGCGCAGCCC SEQ ID
NO:269
pMON35754.seq GCCCCCCCCAGCTGTCTTCGCTTCGTCCAGACCAACATCTCCCGCCTCCTGCAGGAGACCTCCGAG
CAGCTGGTGGCGCTGAAGCCCTGGATCACTCGCCAGAACTTCTCCCGGTGCCTGGAGCTGCAGTGT
CAGCCCGACTCCTCAACCCTGGGCGGTGGGTCAGGAGGTGGGTCAGGAGGTGGATCCGGAGGTGGC
ACCCAGGACTGCTCCTTCCAACACAGCCCCATCTCCTCCGACTTCGCTGTCAAAATCCGTGAGCTG
TCTGACTACCTGCTTCAAGATTACCCAGTCACCGTGGCCTCCAACCTGCAGGACGAGGAGCTCTGC
GGGGGCCTCTGGCGGCTGGTCCTGGCACAGCGCTGGATGGAGCGGCTCAAGACTGTCGCTGGGTCC
AAGATGCAAGGCTTGCTGGAGCGCGTGAACACGGAGATACACTTTGTCACCAAATGTGCCTTTCAG
CCGTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTACACCATTAGGCCCTGCCAGCTCC
GTGCCCCAGAGCTTCCTGCTCAAGTGCTTAGAGCAAGTGAGGAAGATCCAGGGCGATGGCGCAGCG
CTCCAGGAGAAGCTGTGTGCCACCTACAAGCTGTGCCACCCCGAGGAGCTGGTGCTGCTCGGACAC
TCTCTGGGCATCCCCTGGGCTCCCCTGAGCTCCTGCCCCAGCCAGGCCCTGCAGCTGGCAGGCTGC
TTGAGCCAACTCCATAGCGGCCTTTTCCTCTACCAGGGGCTCCTGCAGGCCCTGGAAGGGATATCC
CCCGAGTTGGGTCCCACCTTGGACACACTGCAGCTGGACGTCGCCGACTTTGCCACCACCATCTGG
CAGCAGATGGAAGAACTGGGAATGGCCCCTGCCCTGCAGCCCACCCAGGGTGCCATGCCGGCCTTC
GCCTCTGCTTTCCAGCGCCGGGCAGGAGGGGTCCTGGTTGCTAGCCATCTGCAGAGCTTCCTGGAG
GTGTCGTACCGCGTTATACGCCACCTTGCGCAGCCC SEQ ID NO:270
pMON35755.seq GCTTCAAATCTGCAGGATGAAGAGCTGTGCGGGGGCCTCTGGCGGCTGGTCCTGGCACAGCGCTGG
ATGGAGCGGCTCAAGACTGTCGCTGGGTCCAAGATGCAAGGCTTGCTGGAGCGCGTGAACACGGAG
ATACACTTTGTCACCAAATGTGCCTTTCAGCCCCCCCCCAGCTGTCTTCGCTTCGTCCAGACCAAC
ATCTCCCGCCTCCTGCAGGAGACCTCCGAGCAGCTGGTGGCGCTGAAGCCCTGGATCACTCGCCAG
AACTTCTCCCGGTGCCTGGAGCTGCAGTGTCAGCCCGACTCCTCAACCCTGGGCGGTGGGTCAGGA TABLE 2-continued

GENE SEQUENCES

GGTGGGTCAGGAGGTGGATCCGGAGGTGGCTCAGGGGGAGGTAGTGGTACCCAGGACTGCTCCTTC
CAACACAGCCCCATCTCCTCCGACTTCGCTGTCAAAATCCGTGAGCTGTCTGACTACCTGCTTCAA
GATTACCCAGTCACCGTGGCCTACGTAGAGGGCGGTGGAGGCTCCCCGGGTGAACCGTCTGGTCCA
ATCTCTACTATCAACCCGTCTCATCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCC SEQ ID
NO:271
pMON35756.seq GCTAATCTGCAAGATGAGGAGCTGTGCGGGGGCCTCTGGCGGCTGGTCCTGGCACAGCGCTGGATG
GAGCGGCTCAAGACTGTCGCTGGGTCCAAGATGCAAGGCTTGCTGGAGCGCGTGAACACGGAGATA
CACTTTGTCACCAAATGTGCCTTTCAGCCCCCCCCCAGCTGTCTTCGCTTCGTCCAGACCAACATC
TCCCGCCTCCTGCAGGAGACCTCCGAGCAGCTGGTGGCGCTGAAGCCCTGGATCACTCGCCAGAAC
TTCTCCCGGTGCCTGGAGCTGCAGTGTCAGCCCGACTCCTCAACCCTGGGCGGTGGGTCAGGAGGT
GGGTCAGGAGGTGGATCCGGAGGTGGCTCAGGGGGAGGTAGTGGTACCCAGGACTGCTCCTTCCAA
CACAGCCCCATCTCCTCCGACTTCGCTGTCAAAATCCGTGAGCTGTCTGACTACCTGCTTCAAGAT
TACCCAGTCACCGTGGCCTCCTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTATACGCCACCTTGCGCAGCCC SEQ ID
NO:272
pMON35757.seq GCGCTGCAGGATGAAGAGCTGTGTGGCGGCCTCTGGCGGCTGGTCCTGGCACAGCGCTTGATGGAG
CGGCTCAAGACTGTCGCTGGGTCCAAGATGCAAGGCTTGCTGGAGCGCGTGAACACGGAGATACAC
TTTGTCACCAAATGTGCCTTTCAGCCCCCCCCCAGCTGTCTTCGCTTCGTCCAGACCAACATCTCC
CGCCTCCTGCAGGAGACCTCCGAGCAGCTGGTGGCGCTGAAGCCCTGGATCACTCGCCAGAACTTC
TCCCGGTGCCTGGAGCTGCAGTGTCAGCCCGACTCCTCAACCCTGGGCGGTGGGTCAGGAGGTGGG
TCAGGAGGTGGATCCGGAGGTGGCTCAGGGGGAGGTAGTGGTACCCAGGACTGCTCCTTCCAACAC
AGCCCCATCTCCTCCGACTTCGCTGTCAAAATCCGTGAGCTGTCTGACTACCTGCTTCAAGATTAC
CCAGTCACCGTGGCCTCCAACTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCC SEQ ID
NO:273
pMON35758.seq GCACTGTGCGGTGGTCTGTGGCGTCTGGTCCTGGCACAGCGCTGGATGGAGCGGCTCAAGACTGTC
GCTGGGTCCAAGATGCAAGGCTTGCTGGAGCGCGTGAACACGGAGATACACTTTGTCACCAAATGT
GCCTTTCAGCCCCCCCCCAGCTGTCTTCGCTTCGTCCAGACCAACATCTCCCGCCTCCTGCAGGAG
ACCTCCGAGCAGCTGGTGGCGCTGAAGCCCTGGATCACTCGCCAGAACTTCTCCCGGTGCCTGGAG
CTACAGTGTCAGCCCGACTCCTCAACCCTGGGCGGTGGGTCAGGAGGTGGGTCAGGAGGTGGATCC
GGAGGTGGCTCAGGGGGAGGTAGTGGTACCCAGGACTGCTCCTTCCAACACAGCCCCATCTCCTCC
GACTTCGCTGTCAAAATCCGTGAGCTGTCTGACTACCTGCTTCAAGATTACCCAGTCACCGTGGCC
TCCAACCTGCAGGACGAGGAGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCC SEQ ID
NO:274
pMON35759.seq GCCTCCAAGATGCAAGGCTTGCTGGAGCGCGTGAACACGGAGATACACTTTGTCACCAAATGTGCC
TTTCAGCCCCCCCCCAGCTGTCTTCGCTTCGTCCAGACCAACATCTCCCGCCTCCTGCAGGAGACC TABLE 2-continued

GENE SEQUENCES

TCCGAGCAGCTGGTGGCGCTGAAGCCCTGGATCACTCGCCAGAACTTCTCCCGGTGCCTGGAGCTG
CAGTGTCAGCCCGACTCCTCAACCCTGGGCGGTGGGTCAGGAGGTGGGTCAGGAGGTGGATCCGGA
GGTGGCACCCAGGACTGCTCCTTCCAACACAGCCCCATCTCCTCCGACTTCGCTGTCAAAATCCGT
GAGCTGTCTGACTACCTGCTTCAAGATTACCCAGTCACCGTGGCCTCCAACCTGCAGGACGAGGAG
CTCTGCGGGGCCTCTGGCGGCTGGTCCTGGCACAGCGCTGGATGGAGCGGCTCAAGACTGTCGCT
GGCTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTACACCATTAGGCCCTGCCAGCTCC
CTGCCCCAGAGCTTCCTGCTCAAGTGCTTAGAGCAAGTGAGGAAGATCCAGGGCGATGGCGCAGCG
CTCCAGGAGAAGCTGTGTGCCACCTACAAGCTGTGCCACCCCGAGGAGCTGGTGCTGCTCGGACAC
TCTCTGGGCATCCCCTGGGCTCCCCTGAGCTCCTGCCCCAGCCAGGCCCTGCAGCTGGCAGGCTGC
TTGAGCCAACTCCATAGCGGCCTTTTCCTCTACCAGGGGCTCCTGCAGGCCCTGGAAGGGATATCC
CCCGAGTTGGGTCCCACCTTGGACACACTGCAGCTGGACGTCGCCGACTTTGCCACCACCATCTGG
CAGCAGATGGAAGAACTGGGAATGGCCCCTGCCCTGCAGCCCACCCAGGGTGCCATGCCGGCCTTC
GCCTCTGCTTTCCAGCGCCGGGCAGGAGGGGTCCTGGTTGCTAGCCATCTGCAGAGCTTCCTGGAG
GTGTCGTACCGCGTTCTACGCCACCTTGCGCAGCCC SEQ ID NO:275
pMON35760.seq GCCTCCAAGATGCAAGGCTTGCTGGAGCGCGTGAACACGGAGATACACTTTGTCACCAAATGTGCC
TTTCAGCCCCCCCCAGCTGTCTTCGCTTCGTCCAGACCAACATCTCCCGCCTCCTGCAGGAGACC
TCCGAGCAGCTGGTGGCGCTGAAGCCCTGGATCACTCGCCAGAACTTCTCCCGGTGCCTGGAGCTG
CAGTGTCAGCCCGACTCCTCAACCCTGGGCGGTGGGTCAGGAGGTGGGTCAGGAGGTGGATCCGGA
GGTGGCACCCAGGACTGCTCCTTCCAACACAGCCCCATCTCCTCCGACTTCGCTGTCAAAATCCGT
GAGCTGTCTGACTACCTGCTTCAAGATTACCCAGTCACCGTGGCCTCCAACCTGCAGGACGAGGAG
CTCTGCGGGGCCTCTGGCGGCTGGTCCTGGCACAGCGCTGGATGGAGCGGCTCAAGACTGTCGCT
GGCTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTACACCATTAGGCCCTGCCAGCTCC
CTGCCCCAGAGCTTCCTGCTCAAGTGCTTAGAGCAAGTGAGGAAGATCCAGGGCGATGGCGCAGCG
CTCCAGGAGAAGCTGTGTGCCACCTACAAGCTGTGCCACCCCGAGGAGCTGGTGCTGCTCGGACAC
TCTCTGGGCATCCCCTGGGCTCCCCTGAGCTCCTGCCCCAGCCAGGCCCTGCAGCTGGCAGGCTGC
TTGAGCCAACTCCATAGCGGCCTTTTCCTCTACCAGGGGCTCCTGCAGGCCCTGGAAGGGATATCC
CCCGAGTTGGGTCCCACCTTGGACACACTGCAGCTGGACGTCGCCGACTTTGCCACCACCATCTGG
CAGCAGATGGAAGAACTGGGAATGGCCCCTGCCCTGCAGCCCACCCAGGGTGCCATGCCGGCCTTC
GCCTCTGCTTTCCAGCGCCGGGCAGGAGGGGTCCTGGTTGCTAGCCATCTGCAGAGCTTCCTGGAG
GTGTCGTACCGCGTTCTACGCCACCTTGCGCAGCCC SEQ ID NO:276
pMON35761.seq GCGCTGTGTGGTGGTCTGTGGCGTCTGGTCCTGGCACAGCGCTGGATGGAGCGGCTCAAGACTGTC
GCTGGGTCCAAGATGCAAGGCTTGCTGGAGCGCGTGAACACGGAGATACACTTTGTCACCAAATGT
GCCTTTCAGCCCCCCCCAGCTGTCTTCGCTTCGTCCAGACCAACATCTCCCGCCTCCTGCAGGAG
ACCTCCGAGCAGCTGGTGGCGCTGAAGCCCTGGATCACTCGCCAGAACTTCTCCCGGTGCCTGGAG
CTGCAGTGTCGGCCCGACTCCTCAACCCTGGGCGGTGGGTCAGGAGGTGGGTCAGGAGGTGGATCC
GGAGGTGGCTCAGGGGGAGGTAGTGGTACCCAGGACTGCTCCTTCCAACACAGCCCCATCTCCTCC
AACTTCGCTGTCAAGATCCGTGAGCTGTCTGACTACCTGCTTCAAGATTACCCAGTCACCGTGGCC
TCCAACCTGCAGGACGAGGAGTACGTAGAGGGCGGTGGAGGCTCCCCGGGTGAACCGTCTGGTCCA
ATTTTTACTATCAACCCGTCTCCTCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCC SEQ ID
NO:277
pMON35762.seq GCTGAACTGTGTGGTGGTCTGTGGCGTCTGGTCCTGGCACAGCGCTGGATGGAGCGGCTCAAGACT
GTCGCTGGGTCCAAGATGCAAGGCTTGCTGGAGCGCGTGAACACGGAGATACACTTTGTCACCAAA
TGTGCCTTTCAGCCCCCCCCAGCTGTCTTCGCTTCGTCCAGACCAACATCTCCCGCCTCCTGCAG
GAGACCTCCGAGCAGCTGGTGGCGCTGAAGCCCTGGATCACTCGCCAGAACTTCTCCCGGTGCCTG
GAGCTGCAGTGTCAGCCCGACTCCTCAACCCTGGGCGGTGGGTCAGGAGGTGGGTCAGGAGGTGGA
TCCGGAGGTGGCTCAGGGGGAGGTAGTGGTACCCAGGACTGCTCCTTCCAACACAGCCCCATCTCC
TCCGACTTCGCTGTCAAAATCCGTGAGCTGTCTGACTACCTGCTTCAAGATTACCCAGTCACCGTG
GCCTCCAACCTGCAGGACGAGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCC SEQ ID
NO:278

TABLE 2-continued

GENE SEQUENCES pMON35763.seq

GCTGAAGAACTGTGTGGTGGCCTGTGGCGGCTGGTCCTGGCACAGCGCTGGATGGAGCGGCTCAAG
ACTGTCGCTGGGTCCAAGATGCAAGGCTTGCTGGAGCGCGTGAACACGGAGATACACTTTGTCACC
AAATGTGCCTTTCAGCCCCCCCCCAGCTGTCTTCGCTTCGTCCAGACCAACATCTCCCGCCTCCTG
CAGGAGACCTCCGAGCAGCTGGTGGCGCTGAAGCCCTGGATCACTCGCCAGAACTTCTCCCGGTGC
CTGGAGCTGCAGTGTCAGCCCGACTCCTCAACCCTGGGCGGTGGGTCAGGAGGTGGGTCAGGAGGT
GGATCCGGAGGTGGCTCAGGGGGAGGTAGTGGTACCCAGGACTGCTCCTTCCAACACAGCCCCATC
TCCTCCGACTTCGCTGTCAAAATCCGTGAGCTGTCTGACTACCTGCTTCAAGATTACCCAGTCACC
GTGGCCTCCAACCTGCAGGACTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCC SEQ ID
NO:279 pMON35764.seq

GCTCAGGACGAGGAACTGTGTGGTGGTCTCTGGCGGCTGGTCCTGGCACAGCGCTGGATGGAGCGG
CTCAAGACTGTCGCTGGGTCCAAGATGCAAGGCTTGCTGGAGCGCGTGAACACGGAGATACACTTT
GTCACCAAATGTGCCTTTCAGCCCCCCCCCAGCTGTCTTCGCTTCGTCCAGACCAACATCTCCCGC
CTCCTGCAGGAGACCTCCGAGCAGCTGGTGGCGCTGAAGCCCTGGATCACTCGCCAGAACTTCTCC
CGGTGCCTGGAGCTGCAGTGTCAGCCCGACTCCTCAACCCTGGGCGGTGGGTCAGGAGGTGGGTCA
GGAGGTGGATCCGGAGGTGGCTCAGGGGGAGGTAGTGGTACCCAGGACTGCTCCTTCCAACACAGC
CCCATCTCCTCCGACTTCGCTGTCAAAATCCGTGAGCTGTCTGACTACCTGCTTCAAGATTACCCA
GTCACCGTGGCCTCCAACCTGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACtTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCC SEQ ID
NO:280 pMON35765.seq

GCCACCAACATCTCCCGCCTCCTGCAGGAGACCTCCGAGCAGCTGGTGGCGCTGAAGCCCTGGATC
ACTCGCCAGAACTTCTCCCGGTGCCTGGAGCTGCAGTGTCAGCCCGACTCCTCAACCCTGGGCGGT
GGGTCAGGAGGTGGGTCAGGAGGTGGATCCGGAGGTGGCACCCAGGACTGCTCCTTCCAACACAGC
CCCATCTCCTCCGACTTTGCTGTCAAAATCCGTGAGCTGTCTGACTACCTGCTTCAAGATTACCCA
GTCACCGTGGCCTCCAACCTGCAGGACGAGGAGCTCTGCGGGGGCCTCTGGCGGCTGGTCCTGGCA
CAGCGCTGGATGGAGCGGCTCAAGACTGTCGCTGGGTCCAAGATGCAAGGCTTGCTGGAGCGCGTG
AACACGGAGATACACTTTGTCACCAAATGTGCCTTTCAGCCCCCCCCCAGCTGTCTTCGCTTCGTC
CAGTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTACACCATTAGGCCCTGCCAGCTCC
CTGCCCCAGAGCTTCCTGCTCAAGTGCTTAGAGCAAGTGAGGAAGATCCAGGGCGATGGCGCAGCG
CTCCAGGAGAAGCTGTGTGCCACCTACAAGCTGTGCCACCCCGAGGAGCTGGTGCTGCTCGGACAC
TCTCTGGGCATCCCCTGGGCTCCCCTGAGCTCCTGCCCCAGCCAGGCCCTGCAGCTGGCAGGCTGC
TTGAGCCAACTCCATAGCGGCCTTTTCCTCTACCAGGGGCTCCTGCAGGCCCTGGAAGGGATATCC
CCCGAGTTGGGTCCCACCTTGGACACACTGCAGCTGGACGTCGCCGACTTTGCCACCACCATCTGG
CAGCAGATGGAAGAACTGGGAATGGCCCCTGCCCTGCAGCCCACCCAGGGTGCCATGCCGGCCTTC
GCCTCTGCTTTCCAGCGCCGGGCAGGAGGGGTCCTGGTTGCTAGCCATCTGCAGAGCTTCCTGGAG
GTGTCGTACCGCGTTCTACGCCACCTTGCGCAGCCC SEQ ID NO:281 pMON35766.seq/pMON32190.seq/pMON40001.seq

GCTGATGAAGAACTGTGTGGTGGTCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGTACGTAGAGGGCGGTGGAGGCTCCCCGGGTGGTGGTTCGGCGGC
GGCTCCAACATGGCTACACCATTGGGCCCTGCCAGCTCCCTGCCCCAGAGCTTCCTGCTCAAGTCT
TTAGAGCAAGTGAGAAAGATCCAGGGCGATGGCGCAGCGCTCCAGGAGAAGCTGTGTGCCACCTAC
AAGCTGTGCCACCCCGAGGAGCTGGTGCTGCTCGGACACTCTCTGGGCATCCCCTGGGCTCCCCTG
AGCTCCTGCCCCAGCCAGGCCCTGCAGCTGGCAGGCTGCTTGAGCCAACTCCATAGCGGCCTTTTC
CTCTACCAGGGGCTCCTGCAGGCCCTGGAAGGGATATCCCCCGAGTTGGGTCCCACCTTGGACACA
CTGCAGCTGGACGTCGCCGACTTTGCCACCACCATCTGGCAGCAGATGGAAGAACTGGGAATGGCC
CCTGCCCTGCAGCCCACCCAGGGTGCCATGCCGGCCTTCGCCTCTGCTTTCCAGCGCCGGGCAGGA

TABLE 2-continued

GENE SEQUENCES

GGGGTCCTGGTTGCTAGCCATCTGCAGAGCTTCCTGGAGGTGTCGTACCGCGTTCTACGCCACCTT
GCGCAGCCG SEQ ID NO:282 pMON35768.seq

GCTCAAGATGAAGAACTGTGCGGTGGTCTCTGGCGGCTGGTCCTGGCACAGCGCTGGATGGAGCGG
CTCAAGACTGTCGCTGGGTCCAAGATGCAAGGCTTGCTGGAGCGCGTGAACACGGAGATACACTTT
GTCACCAAATGTGCCTTTCAGCCCCCCCCCAGCTGTCTTCGCTTCGTCCAGACCAACATCTCCCGC
CTCCTGCAGGAGACCTCCGAGCAGCTGGTGGCGCTGAAGCCCTGGATCACTCGCCAGAACTTCTCC
CGGTGCCTGGAGCTGCAGTGTCAGCCCGACTCCTCAACCCTGGGCGGTGGGTCAGGAGGTGGGTCA
GGAGGCGGATCCGGAGGTGGCTCAGGGGGAGGTAGTGGTACCCAGGACTGCTCCTTCCAACACAGC
CCCATCTCCTCCGACTCCGCTGTCAAAATCCGTGAGCTGTCTGACTACCTGCTTCAAGATTACCCA
GTCACCGTGGCCTCCAACCTGTACGTAGAGGGCGGTGGAGGCTCCCGGGTGAACCGTCTGGTCCA
ATCTCTACTATCAACCCGTCTCCTCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCC SEQ ID
NO:283 pMON35770.seq

GCGCTGTGTGGTGGCCTGTGGCGTCTGGTCCTGGCACAGCGCTGGATGGAGCGGCTCAAGACTGTC
GCTGGGTCCAAGATGCAAGGCTTGCTGGAGCGCGTGAACACGGAGATACACTTTGTCACCAAATAT
GCCTTTCAGCCCCCCCCCAGCTGTCTTCGCTTCGTCCAGACCAACATCTCCCGCCTCCTGCAGGAG
ACCTCCGAGCAGCTGGTGGCGCTGAAGCCCTGGATCACTCGCCAGAACTTCTCCCGGTGCCTGGAG
CTGCAGTGTCGGCCCGACTCCTCAACCCTGGGCGGTGGGTCAGGAGGTGGATCCGGAGGTGGCTCA
GGGGGAGGTAGTGGTACCCAGGACTGCTCCTTCCAACACAGCCCCATCTCCTCCGACTTCGCTGTC
AAGATCCGTGAGCTGTCTGACTACCTGCTTCAAGATTACCCAGTCACCGTGGCCTCCAACCTGCAG
GACGAGGAGTACGTAGAGGGCGGTGGAGGCTCCCGGGTGAACCGTCTGGTCCAATCTCTACTATC
AACCCGTCTCCTCCGTCTAAAGAATCTCATAAATCTCCAAACATGGCTACACCATTAGGCCCTGCC
AGCTCCCTGCCCCAGAGCTTCCTGCTCAAGTGCTTAGAGCAAGTGAGGAAGATCCAGGGCGATGGC
GCAGCGCTCCAGGAGAAGCTGTGTGCCACCTACAAGCTGTGCCACCCCGAGGAGCTGGTGCTGCTC
GGACACTCTCTGGGCATCCCCTGGGCTCCCCTGAGCTCCTGCCCCAGCCAGGCCCTGCAGCTGGCA
GGCTGCTTGAGCCAACTCCATAGCGGCCTTTTCCTCTACCAGGGGCTCCTGCAGGCCCTGGAAGGG
ATATCCCCCGAGTTGGGTCCCACCTTGGACACACTGCAGCTGGACGTCGCCGACTTTGCCACCACC
ATCTGGCAGCAGATGGAAGAACTGGGAATGGCCCCTGCCCTGCAGCCCACCCAGGGTGCCATGCCG
GCCTTCGCCTCTGCTTTCCAGCGCCGGGCAGGAGGGGTCCTGGTTGCTAGCCATCTGCAGAGCTTC
CTGGAGGTGTCGTACCGCGTTCTACGCCACCTTGCGCAGCCC SEQ ID NO:284 pMON35772.seq

GCCTCCAAGATGCAAGGCTTGCTGGAGCGCGTGAACACGGAGATACACTTTGTCACCAAATGTGCC
TTTCAGCCCCCCCCCAGCTGTCTTCGCTTCGTCCAGACCAACATCTCCCGCCTCCTGCAGGAGACC
TCCGAGCAGCTGGTGGCGCTGAAGCCCTGGATCACTCGCCAGAACTTCTTCCGGTGCCTGGAGCTG
CAGTGTCAGCCCGACTCCTCAACCCTGGGCGGTGGGTCAGGAGGTGGGTCAGGAGGTGGATCCGGA
GGTGGCACCCAGGACTGCTCCTTCCAACACAGCCCCATCTCCTCCGACTTCGCTGTCAAAATCCGT
GAGCTGTCTGACTACCTGCTTCAAGATTACCCAGTCACCGTGGCCTCCAACCTGCAGGACGAGGAG
CTCTGCGGGGCCTCTGGCGGCTGGTCCTGGCACAGCGCTGGATGGAGCGGCTCAAGACTGTCGCT
GGCTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTACACCATTAGGCCCTGCCAGCTCC
CTGCCCCAGAGCTTCCTGCTCAAGTGCTTAGAGCAAGTGAGGAAGATCCAGGGCGATGGCGCAGCG
CTCCAGGAGAAGCTGTGTGCCACCTACAAGCTGTGCCACCCCGAGGAGCTGGTGCTGCTCGGACAC
TCTCTGGGCATCCCCTGGGCTCCCCTGAGCTCCTGCCCCAGCCAGGCCCTGCAGCTGGCAGGCTGC
TTGAGCCAACTCCATAGCGGCCTTTTCCTCTACCAGGGGCTCCTGCAGGCCCTGGAAGGGATATCC
CCCGAGTTGGGTCCCACCTTGGACACACTGCAGCTGGACGTCGCCGACTTTGCCACCACCATCTGG
CAGCAGATGGAAGAACTGGGAATGGCCCCTGCCCTGCAGCCCACCCAGGGTGCCATGCCGGCCTTC
GCCTCTGCTTTCCAGCGCCGGGCAGGAGGGGTCCTGGTTGCTAGCCATCTGCAGAGCTTCCTGGAG
GTGTCGTACCGCGTTCTACGCCACCTTGCGCAGCCC SEQ ID NO:285 pMON35773.seq

GCTCAAGACGAAGAACTGTGTGGTGGTCTCTGGCGGCTGGTCCTGGCACAGCGCTGGATGGAGCGG
CTCAAGACTGTCGCTGGGTCCAAGATGCAAGGCTTGCTGGAGCGCGTGAACACGGAGATACACTTT
GTCACCAAATGTGCCTTTCAGCCCCCCCCCAGCTGTCTTCGCTTCGTCCAGACCAACATCTCCCGC
CTCCTGCAGGAGACCTCCGAGCAGCTGGTGGCGCTGAAGCCCTGGATCACTCGCCAGAACTTCTCC
CGGTGCCTGGAGCTGCAGTGTCAGCCCGACTCCTCAACCCTGGGCGGTGGGTCAGGAGGTGGGTCA
GGCGGTGGTTCTGGCGGAGGATCCGGCGGCGGAAGCGGAGGTGGCTCTGGGGGAGGTAGTGGTACC
CAGGACTGCTCCTTCCAACACAGCCCCATCTCCTCCGACTTCGCTGTCAAAATCCGTGAGCTGTCT
GACTACCTGCTTCAAGATTACCCAGTCACCGTGGCCTCCAACCTGTACGTAGAGGGCGGTGGAGGC
TCCCCGGGTGAACCGTCTGGTCCAATCTCTACTATCAACCCGTCTCCTCCGTCTAAAGAATCTCAT
AAATCTCCAAACATGGCTACACCATTAGGCCCTGCCAGCTCCCTGCCCCAGAGCTTCCTGCTCAAG
TGCTTAGAGCAAGTGAGGAAGATCCAGGGCGATGGCGCAGCGCTCCAGGAGAAGCTGTGTGCCACC
TACAAGCTGTGCCACCCCGAGGAGCTGGTGCTGCTCGGACACTCTCTGGGCATCCCCTGGGCTCCC
CTGAGCTCCTGCCCCAGCCAGGCCCTGCAGCTGGCAGGCTGCTTGAGCCAACTCCATAGCGGCCTT
TTCCTCTACCAGGGGCTCCTGCAGGCCCTGGAAGGGATATCCCCCGAGTTGGGTCCCACCTTGGAC
ACACTGCAGCTGGACGTCGCCGACTTTGCCACCACCATCTGGCAGCAGATGGAAGAACTGGGAATG

TABLE 2-continued

GENE SEQUENCES

GCCCCTGCCCTGCAGCCCACCCAGGGTGCCATGCCGGCCTTCGCCTCTGCTTTCCAGCGCCGGGCA
GGAGGGGTCCTGGTTGCTAGCCATCTGCAGAGCTTCCTGGAGGTGTCGTACCGCGTTCTACGCCAC
CTTGCGCAGCCC SEQ ID NO:286
pNON35777.seq GCCCAAGATGAAGAACTGTGTGGTGGCCTCTGGCGGCTGGTCCTGGCACAGCGCTGGATGGAGCGG
CTCAAGACTGTCGCTGGGTCCAAGATGCAAGGCTTGCTGGAGCGCGTGAACACGGAGATACACTTT
GTCACCAAATGTGCCTTTCAGCCCCCCCCCAGCTGTCTTCGCTTCGTCCAGACCAACATCTCCCGC
CTCCTGCAGGAGACCTCCGAGCAGCTGGTGGCGCTGAAGCCCTGGATCACTCGCCAGAACTTCTCC
CGGTGCCTGGAGCTGCAGTGTCAGCCCGACTCCTCAACCCTGCCGCCACCGTGGAGCCCGCGTCCA
CTCGGCGCCACCGCACCGACCACCCAGGACTGCTCCTTCCAACACAGCCCCATCTCCTCCGACTTC
GCTGTCAAAATCCGTGAGCTGTCTGACTACCTGCTTCAAGATTACCCAGTCACCGTGGCCTCCAAC
CTGTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTACACCATTAGGCCCTGCCAGCTCC
CTGCCCCAGAGCTTCCTGCTCAAGTGCTTAGAGCAAGTGAGGAAGATCCAGGGCGATGGCGCAGCG
CTCCAGGAGAAGCTGTGTGCCACCTACAAGCTGTGCCACCCCGAGGAGCTGGTGCTGCTCGGACAC
TCTCTGGGCATCCCCTGGGCTCCCCTGAGCTCCTGCCCCAGCCAGGCCCTGCAGCTGGCAGGCTGC
TTGAGCCAACTCCATAGCGGCCTTTTCCTCTACCAGGGGCTCCTGCAGGCCCTGGAAGGGATATCC
CCCGAGTTGGGTCCCACCTTGGACACACTGCAGCTGGACGTCGCCGACTTTGCCACCACCATCTGG
CAGCAGATGGAAGAACTGGGAATGGCCCCTGCCCTGCAGCCCACCCAGGGTGCCATGCCGGCCTTC
GCCTCTGCTTTCCAGCGCCGGGCAGGAGGGGTCCTGGTTGCTAGCCATCTGCAGAGCTTCCTGGAG
GTGTCGTACCGCGTTCTACGCCACCTTGCGCAGCCC SEQ ID NO:287
pMON35778.seq GCCCAAGATGAAGAACTGTGTGGTGGCCTCTGGCGGCTGGTCCTGGCACAGCGCTGGATGGAGCGG
CTCAAGACTGTCGCTGGGTCCAAGATGCAAGGCTTGCTGGAGCGCGTGAACACGGAGATACACTTT
GTCACCAAATGTGCCTTTCAGCCCCCCCCCAGCTGTCTTCGCTTCGTCCAGACCAACATCTCCCGC
CTCCTGCAGGAGACCTCCGAGCAGCTGGTGGCGCTGAAGCCCTGGATCACTCGCCAGAACTTCTCC
CGGTGCCTGGAGCTGCAGTGTCAGCCCGACTCCTCAACCCTGCCGCCACCGTGGAGCCCGCGTCCA
CTCGGCGCCACCGCACCGACCGCTGGACAACGCCTCTGACCCAGGACTGCTCCTTCCAACACAGC
CCCATCTCCTCCGACTTCGCTGTCAAAATCCGTGAGCTGTCTGACTACCTGCTTCAAGATTACCCA
GTCACCGTGGCCTCCAACCTGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCC SEQ ID
NO:288
pMON35779.seq GCTGATGAAGAACTGTGTGGTGGGCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGC
GGTGGTTCTGGCGGAGGATCCGGCGGCGGAAGCGGAGGTGGCTCTGGGGGAGGTAGTGGTACCCAG
GACTGCTCCTTCCAACACAGCCCCATCTCCTCCGACTTCGCTGTCAAAATCCGTGAGCTGTCTGAC
TACCTGCTTCAAGATTACCCAGTCACCGTGGCCTCCAACCTGCAGTACGTAGAGGGCGGTGGAGGC
TCCCCGGGTGAACCGTCTGGTCCAATCTCTACTATCAACCCGTCTCCTCCGTCTAAAGAATCTCAT
AAATCTCCAAACATGGCTACACCATTAGGCCCTGCCAGCTCCCTGCCCCAGAGCTTCCTGCTCAAG
TGCTTAGAGCAAGTGAGGAAGATCCAGGGCGATGGCGCAGCGCTCCAGGAGAAGCTGTGTGCCACC
TACAAGCTGTGCCACCCCGAGGAGCTGGTGCTGCTCGGACACTCTCTGGGCATCCCCTGGGCTCCC
CTGAGCTCCTGCCCCAGCCAGGCCCTGCAGCTGGCAGGCTGCTTGAGCCAACTCCATAGCGGCCTT
TTCCTCTACCAGGGGCTCCTGCAGGCCCTGGAAGGGATATCCCCCGAGTTGGGTCCCACCTTGGAC
ACACTGCAGCTGGACGTCGCCGACTTTGCCACCACCATCTGGCAGCAGATGGAAGAACTGGGAATG
GCCCCTGCCCTGCAGCCCACCCAGGGTGCCATGCCGGCCTTCGCCTCTGCTTTCCAGCGCCGGGCA
GGAGGGGTCCTGGTTGCTAGCCATCTGCAGAGCTTCCTGGAGGTGTCGTACCGCGTTCTACGCCAC
CTTGCGCAGCCC SEQ ID NO.289
pMON35780.seq GCTGATGAAGAACTGTGTGGTGGGCTGTGGCGGCTGGTCCTGGCACAGCGCTGGATGGAGCGGCCC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGC
GGTGGTTCTGGCGGAGGATCCGGCGGCGGAAGCGGAGGTGGCTCTGGGGGAGGTAGTGGTACCCAG
GACTGCTCCTTCCAACACAGCCCCATCTCCTCCGACTTCGCTGTCAAAATCCGTGAGCTGTCTGAC
TACCTGCTTCAAGATTACCCAGTCACCGTGGCCTCCAACCTGCAGTACGTAGAGGGCGGTGGAGGC
TCCCCGGGTGAACCGTCTGGTCCAATCTCTACTATCAACCCGTCTCCTCCGTCTAAAGAATCTCAT
AAATCTCCAAACATGGCTACACCATTAGGCCCTGCCAGCTCCCTGCCCCAGAGCTTCCTGCTCAAG
TGCTTAGAGCAAGTGAGGAAGATCCAGGGCGATGGCGCAGCGCTCCAGGAGAAGCTGTGTGCCACC
TACAAGCTGTGCCACCCCGAGGAGCTGGTGCTGCTCGGACACTCTCTGGGCATCCCCTGGGCTCCC
CTGAGCTCCTGCCCCAGCCAGGCCCTGCAGCTGGCAGGCTGCTTGAGCCAACTCCATAGCGGCCTT TABLE 2-continued

GENE SEQUENCES

TTCCTCTACCAGGGGCTCCTGCAGGCCCTGGAAGGGATATCCCCCGAGTTGGGTCCCACCTTGGAC
ACACTGCAGCTGGACGTCGCCGACTTTGCCACCACCATCTGGCAGCAGATGGAAGAACTGGGAATG
GCCCCTGCCCTGCAGCCCACCCAGGGTGCCATGCCGGCCTTCGCCTCTGCTTTCCAGCGCCGGGCA
GGAGGGGTCCTGGTTGCTAGCCATCTGCAGAGCTTCCTGGAGGTGTCGTACCGCGTTCTACGCCAC
CTTGCGCAGCCC SEQ ID NO:290
pMON35782.seq GCGGACGAGGAGCTGTGCGGTGGCCTCTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGCCGCCACCGTGGAGCCCGCGTCCACTC
GGCGCCACCGCACCGACCGCTGGACAACCGCCTCTGACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGTACGTAGAGGGCGGTGGAGGCACCCCGGGTGAACCGTCTGGTCCA
ATCTCTACTATCAACCCGTCTCCTCCGTCTAAAGAATCTCATAAATCTCCAAACATGGCTACACCA
TTAGGCCCTGCCAGCTCCCTGCCCCAGAGCTTCCTGCTCAAGTGCTTAGAGCAAGTGAGGAAGATC
CAGGGCGATGGCGCAGCGCTCCAGGAGAAGCTGTGTGCCACCTACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG
GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCC SEQ ID
NO:291
pMON39908.seq GCTGATGAGGAGCTGTGTGGTGGTCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGTAGAGACGGTGTTTCACCGTGTCAGCCAGGATGGTCTAGAT
CTCCTGACCTCGACCCAGGACTGCTCCTTCCAACACAGCCCCATCTCCTCCGACTTCGCTGTCAAA
ATCCGTGAGCTGTCTGACTACCTGCTTCAAGATTACCCAGTCACCGTGGCCTCCAACCTGCAGTAC
GTAGAGGGCGGTGGAGGCTCCCCGGGTGGTGGTTCTGGCGGCGGCTCCAACATGGCTACACCATTG
GGCCCTGCCAGCTCCCTGCCCCAGAGCTTCCTGCTCAAGTCTTTAGAGCAAGTGAGAAAGATCCAG
GGCGATGGCGCAGCGCTCCAGGAGAAGCTGTGTGCCACTAACAAGCTGTGCCACCCCGAGGAGCTG
GTGCTGCTCGGACACTCTCTGGGCATCCCCTGGGCTCCCCTGAGCTCCTGCCCCAGCCAGGCCCTG
CAGCTGGCAGGCTGCTTGAGCCAACTCCATAGCGGCCTTTTCCTCTACCAGGGGCTCCTGCAGGCC
CTGGAAGGGATATCCCCCGAGTTGGGTCCCACCTTGGACACACTGCAGCTGGACGTCGCCGACTTT
GCCACCACCATCTGGCAGCAGATGGAAGAACTGGGAATGGCCCCTGCCCTGCAGCCCACCCAGGGT
GCCATGCCGGCCTTCGCCTCTGCTTTCCAGCGCCGGGCAGGAGGGGTCCTGGTTGCTAGCCATCTG
CAGAGCTTCCTGGAGGTGTCGTACCGCGTTCTACGCCACCTTGCGCAGCCG SEQ ID NO: 292
pMON32275.seq GCTGATGAAGAACTGTGTGGTGGGCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGTACGTAGAGGGCGGTGGAGGCTCCCCG
GGTGAACCGTCTGGTCCAATCTCTACTATCAACCCGTCTCCTCCGTCTAAAGAATCTCATAAATCT
CCAAACATGGCTACACCATTGGGCCCTGCCAGCTCCCTGCCCCAGAGCTTCCTGCTCAAGTCTTTA
GAGCAAGTGAGAAAGATCCAGGGCGATGGCGCAGCGCTCCAGGAGAAGCTGTGTGCCACCTACAAG
CTGTGCCACCCCGAGGAGCTGGTGCTGCTCGGACACTCTCTGGGCATCCCCTGGGCTCCCCTGAGC
TCCTGCCCCAGCCAGGCCCTGCAGCTGGCAGGCTGCTTGAGCCAACTCCATAGCGGCCTTTTCCTC
TACCAGGGGCTCCTGCAGGCCCTGGAAGGGATATCCCCCGAGTTGGGTCCCACCTTGGACACACTG
CAGCTGGACGTCGCCGACTTTGCCACCACCATCTGGCAGCAGATGGAAGAACTGGGAATGGCCCCT
GCCCTGCAGCCCACCCAGGGTGCCATGCCGGCCTTCGCCTCTGCTTTCCAGCGCCGGGCAGGAGGG
GTCCTGGTTGCTAGCCATCTGCAGAGCTTCCTGGAGGTGTCGTACCGCGTTCTACGCCACCTTGCG
CAGCCCTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCAACCCAGGACTGCTCTTTTCAA
CACAGCCCCATCTCCTCCGACTTCGCTGTCAAAATCCGTGAGCTGTCTGACTACCTGCTTCAAGAT
TACCCAGTCACCGTGGCCTCCAACCTGCAG SEQ ID NO:293
pMON35781.seq GCCACCCAGGACTGCTCCTTTCAACACAGCCCCATCTCCTCCGACTTCGCTGTCAAAATCCGTGAG
CTGTCTGACTACCTGCTTCAAGATTACCCAGTCACCGTGGCCTCCAACCTGCAGGAGCCGAAGAGC
CCGGACACCCATACTAGTCCGACATCTCCGACACCATTAGGCCCTGCCAGCTCCCTGCCCCAGAGC
TTCCTGCTCAAGTCTTTAGAGCAAGTGAGAAAGATCCAGGGCGATGGCGCAGCGCTCCAGGAGAAG
CTGTGTGCCACCTACAAGCTGTGCCACCCCGAGGAGCTGGTGCTGCTCGGACACTCTCTGGGCATC
CCCTGGGCTCCCCTGAGCTCCTGCCCCAGCCAGGCCCTGCAGCTGGCAGGCTGCTTGAGCCAACTC
CATAGCGGCCTTTTCCTCTACCAGGGGCTCCTGCAGGCCCTGGAAGGGATATCCCCCGAGTTGGGC
CCCACCTTGGACACACTGCAGCTGGACGTCGCCGACTTTGCCACCACCATCTGGCAGCAGATGGAA
GAACTGGGAATGGCCCCTGCCCTGCAGCCCACCCAGGGTGCCATGCCGGCCTTCGCCTCTGCTTTC
CAGCGCCGGGCAGGAGGGGTCCTGGTTGCTAGCCATCTGCAGAGCTTCCTGGAGGTGTCGTACCGC
GTTCTACGCCACCTTGCGCAGCCCTCTGCAGAACCGAAATCTCCGGATACTCATACCAGCCCGCCA
TCCCCGGGTTCTAATCTGCAAGATGAAGAGCTGTGCGGGGGCCTCTGGCGGCTGGTCCTGGCACAG TABLE 2-continued

GENE SEQUENCES

CGCTGGATGGAGCGGCTCAAGACTGTCGCTGGGTCCAAGATGCAAGGCTTGCTGGAGCGCGTGAAC
ACGGAGATACACTTTGTCACCAAATGTGCCTTTCAGCCCCCCCCCAGCTGCCTTCGCTTCGTCCAG
ACCAACATCTCCCGCCTCCTGCAGGAGACCTCCGAGCAGCTGGTGGCGCTGAAGCCCTGGATCACT
CGCCAGAACTTCTCCCGGTGCCTGGAGCTGCAGTGTCAGCCCGACTCCTCAACCCTG SEQ ID
NO:294
pMON35783.seq GCCACCCAGGACTGCTCCTTTCAACACAGCCCCATCTCCTCCGACTTCGCTGTCAAAATCCGTGAG
CTGTCTGACTACCTGCTTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCTCAAGACTGTCGCTGGG
TCCAAGATGCAAGGCTGGCAGGGGCGCGTGAACACGGAGATACACTTTGTCACCAAATGTGCCTTT
CCGAAGAGCCCGGACACCCATACTAGTCCGCCATCTCCGGGTACACCATTGGGCCCTGCCAGCTCC
CTGCCCCAGAGCTTCCTGCTCAAGTCTTTAGAGCAAGTGAGAAAGATCCAGGGCGATGGCGCAGCG
CTCCAGGAGAAGCTGTGTGCCACTACAAGCTGTGCCACCCCAGGAGCTGGTGCTGCTCGGACACT
CTCTGGGCATCCCCTGGGCTCCCCTGAGCTCCTGCCCCAGCCAGGCCCTGCAGCTGGCAGGCTGCT
TGAGCCAACTCCATAGCGGCCTTTTCCTCTACCAGGGGCTCCTGCAGGCCCTGGAAGGGATATCCC
CCGAGTTGGGTCCCACCTTGGACACACTGCAGCTGGACGTCGCCGACTTTGCCACCACCATCTGGC
AGCAGATGGAAGAACTGGGAATGGCCCCTGCCCTGCAGCCCACCCAGGGTGCCATGCCGGCCTTCG
CCTCTGCTTTCCAGCGCCGGGCAGGAGGGGTCCTGGTTGCTAGCCATCTGCAGAGCTTCCTGGAGG
TGTCGTACCGCGTTCTACGCCACCTTGCGCAGCCCTCTGCAGAACCGAAATCTCCGGATACTCATA
CCAGCCCGCCATCCCCGGGTAAGGCCTTTCAGCCCCCCCCCAGCTGTCTTCGCTTCGTCAGACCA
ACATCTCCCGCCTCCTGCAGGAGACCTCCGAGCAGCTGGTGGCGCTGAAGCCCTGGATCACTCGCC
AGAACTTCTCCCGGTGCCTGGAGCTGCAGTGTCAGCCCGACTCCTCAACCCTG SEQ ID
NO:295
pMON32276.seq GCTGATGAAGAACTGTGTGGTGGTCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATCTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTCCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGTACGTAGAGGGCGGTGGAGGCTCCCCGGGTGGTGGTTCGGCGGC
GGCTCCAACATGGCTACACCATTGGGCCCTGCCAGCTCCCTGCCAGCTCCCTGCCCCAGAGCTTCCTGCTCAAGTCT
TTAGAGCAAGTGAGAAAGATCCAGGGCGATGGCGCAGCGCTCCAGGAGAAGCTGTGTGCCACTAAC
AAGCTGTGCCACCCCGAGGAGCTGGTGCTGCTCGGACACTCTCTGGGCATCCCCTGGGCTCCCCTG
AGCTCCTGCCCCAGCCAGGCCCTGCAGCTGGCAGGCTGCTTGAGCCAACTCCATAGCGGCCTTTTC
CTCTACCAGGGGCTCCTGCAGGCCCTGGAAGGGATATCCCCCGAGTTGGGTCCCACCTTGGACACA
CTGCAGCTGGACGTCGCCGACTTTGCCACCACCATCTGGCAGCAGATGGAAGAACTGGGAATGGCC
CCTGCCCTGCAGCCCACCCAGGGTGCCATGCCGGCCTTCGCCTCTGCTTTCCAGCGCCGGGCAGGA
GGGGTCCTGGTTGCTAGCCATCTGCAGAGCTTCCTGGAGGTGTCGTACCGCGTTCTACGCCACCTT
GCGCAGCCG SEQ ID NO:296
pMON32277.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCTGATGAAGAACTGTGTGGTGGTCTGTGGCGG
CTGGTCCTGGCACAGCGCTGGATGGAGCGGCTCAAGACTGTCGCTGGGTCCAAGATGCAAGGCTTG
CTGGAGCGCGTGAACACGGAGATACACTTTGTCACCAAATCTGCCTTTCAGCCCCCCCCCAGCTGT
CTTCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCAGCCCGACTCCTCA
ACCCTGGGCGGTGGGTCAGGAGGTGGGTCAGGAGGTGGATCCGGAGGTGGCTCAGGGGGAGGTAGT
GGTACCCAGGACTCCTCCTTCCAACACAGCCCCATCTCCTCCGACTTCGCTGTCAAAATCCGCGAG
CTGTCTGACTACCTGCTTCAAGATTACCCAGTCACCGTGGCCTCCAACCTGCAG SEQ ID
NO:297
pMON32278.seq GCTGATGAAGAACTGTGTGGTGGTCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTCTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTAGAGCTGCAGTCTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGTACGTAGAGGGCGGTGGAGGCTCCCCGGGTGGTGGTTCTGGCGGC
GGCTCCAACATGGCTACACCATTGGGCCCTGCCAGCTCCCTGCCCCAGAGCTTCCTGCTCAAGTCT
TTAGAGCAAGTGAGAAAGATCCAGGGCGATGGCGCAGCGCTCCAGGAGAAGCTGTGTGCCACTAAC
AAGCTGTGCCACCCCGAGGAGCTGGTGCTGCTCGGACACTCTCTGGGCATCCCCTGGGCTCCCCTG
AGCTCCTGCCCCAGCCAGGCCCTGCAGCTGGCAGGCTGCTTGAGCCAACTCCATAGCGGCCTTTTC

TABLE 2-continued

GENE SEQUENCES

CTCTACCAGGGGCTCCTGCAGGCCCTGGAAGGGATATCCCCCGAGTTGGGTCCCACCTTGGACACA
CTGCAGCTGGACGTCGCCGACTTTGCCACCACCATCTGGCAGCAGATGGAAGAACTGGGAATGGCC
CCTGCCCTGCAGCCCACCCAGGGTGCCATGCCGGCCTTCGCCTCTGCTTTCCAGCGCCGGGCAGGA
GGGGTCCTGGTTGCTAGCCATCTGCAGAGCTTCCTGGAGGTGTCGTACCGCGTTCTACGCCACCTT
GCGCAGCCG SEQ ID NO:298
pMON32279.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCAGATGAAGAACTGTGTGGGGGCCTGTGGCGG
CTGGTCCTGGCACAGCGCTGGATGGAGCGGCTCAAGACTGTCGCTGGGTCCAAGATGCAAGGCTTG
CTGGAGCGCGTGAACACGGAGATACACTTTGTCACCAAATGTGCCTTTCAGCCCCCCCCCAGCTCT
CTTCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTCTCAGCCCGACTCCTCA
ACCCTGGGCGGTGGGTCAGGAGGTGGGTCAGGAGGTGGATCCGGAGGTGGCTCAGGGGGAGGTAGT
GGTACTCAGGACTGTTCTTTTCAACACAGCCCCATCTCCTCCGACTTCGCTGTCAAAATCCGTGAG
CTGTCTGACTACCTGCTTCAAGATTACCCAGTCACCGTGGCCTCCAACCTGCAG SEQ ID
NO:299
pMON35790.seq GCCACTCAGGACTCCTCTTTTCAACACAGCCCCATCTCCTCCGACTTCGCTGTCAAAATCCGTGAG
CTGTCTGACTACCTGCTTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCTCAAGACTGTCGCTGGG
TCCAAGATGCAAGGCTTGCTGGAGCGCGTGAACACGGAGATACACTTTGTCACCAAATCTGCCTTT
CAGCCCCCCCCCAGCTGTCTTCGCTTCGTCCAGACCAACATCTCCCGCCTCCTGCAGGAGACCTCC
GAGCAGCTGGTGGCGCTGAAGCCCTGGATCACTCGCCAGAACTTCTCCCGGTGCCTGGAGCTGCAG
TGTCAGCCCGACTCCTCAACCCTGTACGTAGAGGGCGGTGGAGGCTCCCCGGGTGGTGGTTCTGGC
GGCGGCTCCAACATGGCTACACCATTGGGCCCTGCCAGCTCCCTGCCCCAGAGCTTCCTGCTCAAG
TCTTTAGAGCAAGTGAGAAAGATCCAGGGCGATGGCGCAGCGCTCCAGGAGAAGCTGTGTGCCACT
AACAAGCTGTGCCACCCCGAGGAGCTGGTGCTGCTCGGACACTCTCTGGGCATCCCCTGGGCTCCC
CTGAGCTCCTGCCCCAGCCAGGCCCTGCAGCTGGCAGGCTGCTTGAGCCAACTCCATAGCGGCCTT
TTCCTCTACCAGGGGCTCCTGCAGGCCCTGGAAGGGATATCCCCCGAGTTGGGTCCCACCTTGGAC
ACACTGCAGCTGGACGTCGCCGACTTTGCCACCACCATCTGGCAGCAGATGGAAGAACTGGGAATG
GCCCCTGCCCTGCAGCCCACCCAGGGTGCCATGCCGGCCTTCGCCTCTGCTTTCCAGCGCCGGGCA
GGAGGGGTCCTGGTTGCTAGCCATCTGCAGAGCTTCCTGGAGGTGTCGTACCGCGTTCTACGCCAC
CTTGCGCAGCCG SEQ ID NO:300
pMON35791.seq GCCACTCAGGACTGTTCTTTTCAACACAGCCCCATCTCCTCCGACTTCGCTGTCAAAATCCGTGAG
CTGTCTGACTACCTGCTTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCTCAAGACTGTCGCTGGG
TCCAAGATGCAAGGCTTGCTGGAGCGCGTGAACACGGAGATACACTTTGTCACCAAATGTGCCTTT
CAGCCCCCCCCCAGCTCTCTTCGCTTCGTCCAGACCAACATCTCCCGCCTCCTGCAGGAGACCTCC
GAGCAGCTGGTGGCGCTGAAGCCCTGGATCACTCGCCAGAACTTCTCCCGGTGCCTGGAGCTGCAG
TCTCAGCCCGACTCCTCAACCCTGTACGTAGAGGGCGGTGGAGGCTCCCCGGGTGGTGGTTCTGGC
GGCGGCTCCAACATGGCTACACCATTGGGCCCTGCCAGCTCCCTGCCCCAGAGCTTCCTGCTCAAG
TCTTTAGAGCAAGTGAGAAAGATCCAGGGCGATGGCGCAGCGCTCCAGGAGAAGCTGTGTGCCACC
TACAAGCTGTGCCACCCCGAGGAGCTGGTGCTGCTCGGACACTCTCTGGGCATCCCCTGGGCTCCC
CTGAGCTCCTGCCCCAGCCAGGCCCTGCAGCTGGCAGGCTGCTTGAGCCAACTCCATAGCGGCCTT
TTCCTCTACCAGGGGCTCCTGCAGGCCCTGGAAGGGATATCCCCCGAGTTGGGTCCCACCTTGGAC
ACACTGCAGCTGGACGTCGCCGACTTTGCCACCACCATCTGGCAGCAGATGGAAGAACTGGGAATG
GCCCCTGCCCTGCAGCCCACCCAGGGTGCCATGCCGGCCTTCGCCTCTGCTTTCCAGCGCCGGGCA
GGAGGGGTCCTGGTTGCTAGCCATCTGCAGAGCTTCCTGGAGGTGTCGTACCGCGTTCTACGCCAC
CTTGCGCAGCCG SEQ ID NO:301
pMON35792.seq GCCACTCAGGACTGTTCTTTTCAACACAGCCCCATCTCCTCCGACTTCGCTGTCAAAATCCGTGAG
CTGTCTGACTACCTGCTTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCTCAAGACTGTCGCTGGG
TCCAAGATGCAAGGCTTGCTGGAGCGCGTGAACACGGAGATACACTTTGTCACCAAATGTGCCTTT
CAGCCCCCCCCCAGCTGTCTTCGCTTCGTCCAGACCAACATCTCCCGCCTCCTGCAGGAGACCTCC
GAGCAGCTGGTGGCGCTGAAGCCCTGGATCACTCGCCAGAACTTCTCCCGGTGCCTGGAGCTGCAG
TACGTAGAGGGCGGTGGAGGCTCCCCGGGTGGTGGTTCTGGCGGCGGCTCCAACATGGCTACACCA
TTGGGCCCTGCCAGCTCCCTGCCCCAGAGCTTCCTGCTCAAGTCTTTAGAGCAAGTGAGAAAGATC
CAGGGCGATGGCGCAGCGCTCCAGGAGAAGCTGTGTGCCACTAACAAGCTGTGCCACCCCGAGGAG
CTGGTGCTGCTCGGACACTCTCTGGGCATCCCCTGGGCTCCCCTGAGCTCCTGCCCCAGCCAGGCC
CTGCAGCTGGCAGGCTGCTTGAGCCAACTCCATAGCGGCCTTTTCCTCTACCAGGGGCTCCTGCAG
GCCCTGGAAGGGATATCCCCCGAGTTGGGTCCCACCTTGGACACACTGCAGCTGGACGTCGCCGAC
TTTGCCACCACCATCTGGCAGCAGATGGAAGAACTGGGAATGGCCCCTGCCCTGCAGCCCACCCAG TABLE 2-continued

GENE SEQUENCES

GGTGCCATGCCGGCCTTCGCCTCTGCTTTCCAGCGCCGGGCAGGAGGGGTCCTGGTTGCTAGCCAT
CTGCAGAGCTTCCTGGAGGTGTCGTACCGCGTTCTACGCCACCTTGCGCAGCCG SEQ ID
NO:302
pMON39905.seq GCCACTCAGGACTGTTCTTTTCAACACAGCCCCATCTCCTCCGACTTCGCTGTCAAAATCCGTGAG
CTGTCTGACTACCTGCTTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCTCAAGACTGTCGCTGGG
TCCAAGATGCAAGGCTTGCTGGAGCGCGTGAACACGGAGATACACTTTGTCACCAAATGTGCCTTT
CAGCCCCCCCCCAGCTGTCTTCGCTTCGTCCAGACCAACATCTCCCGCCTCCTGCAGGAGACCTCC
GAGCAGCTGGTGGCGCTGAAGCCCTGGATCACTCGCCAGAACTTCTCCCGGTGCCTGGAGCTGCAG
TCTCAGCCCGACTCCTCAACCCTGTACGTAGAGGGCGGTGGAGGCTCCCGGGTGGTGGTTCTGGC
GGCGGCTCCAACATGGCTACACCATTGGGCCCTGCCAGCTCCCTGCCCCAGAGCTTCCTGCTCAAG
TCTTTAGAGCAAGTGAGAAAGATCCAGGGCGATGGCGCAGCGCTCCAGGAGAAGCTGTGTGCCACC
TACAAGCTGTGCCACCCCGAGGAGCTGGTGCTGCTCGGACACTCTCTGGGCATCCCCTGGGCTCCC
CTGAGCTCCTGCCCCAGCCAGGCCCTGCAGCTGGCAGGCTGCTTGAGCCAACTCCATAGCGGCCTT
TTCCTCTACCAGGGGCTCCTGCAGGCCCTGGAAGGGATATCCCCCGAGTTGGGTCCCACCTTGGAC
ACACTGCAGCTGGACGTCGCCGACTTTGCCACCACCATCTGGCAGCAGATGGAAGAACTGGGAATG
GCCCCTGCCCTGCAGCCCACCCAGGGTGCCATGCCGGCCTTCGCCTCTGCTTTCCAGCGCCGGGCA
GGAGGGGTCCTGGTTGCTAGCCATCTGCAGAGCTTCCTGGAGGTGTCGTACCGCGTTCTACGCCAC
CTTGCGCAGCCG SEQ ID NO:303
pMON39906.seq GCCACTCAGGACTGTTCTTTTCAACACAGCCCCATCTCCTCCGACTTCGCTGTCAAAATCCGTGAG
CTGTCTGACTACCTGCTTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCTCAAGACTGTCGCTGGG
TCCAAGATGCAAGGCTTGCTGGAGCGCGTGAACACGGAGATACACTTTGTCACCAAATGTGCCTTT
CAGCCCCCCCCCAGCTGTCTTCGCTTCGTCCAGACCAACATCTCCCGCCTCCTGCAGGAGACCTCC
GAGCAGCTGGTGGCGCTGAAGCCCTGGATCACTCGCCAGAACTTCTCCCGGCGCCTGGAGCTGCAG
TCTCAGCCCGACTCCTCAACCCTGTACGTAGAGGGCGGTGGAGGCTCCCGGGTGGTGGTTCTGGC
GGCGGCTCCAACATGGCTACACCATTGGGCCCTGCCAGCTCCCTGCCCCAGAGCTTCCTGCTCAAG
TCTTTAGAGCAAGTGAGAAAGATCCAGGGCGATGGCGCAGCGCTCCAGGAGAAGCTGTGTGCCACT
AACAAGCTGTGCCACCCCGAGGAGCTGGTGCTGCTCGGACACTCTCTGGGCATCCCCTGGGCTCCC
CTGAGCTCCTGCCCCAGCCAGGCCCTGCAGCTGGCAGGCTGCTTGAGCCAACTCCATAGCGGCCTT
TTCCTCTACCAGGGGCTCCTGCAGGCCCTGGAAGGGATATCCCCCGAGTTGGGTCCCACCTTGGAC
ACACTGCAGCTGGACGTCGCCGACTTTGCCACCACCATCTGGCAGCAGATGGAAGAACTGGGAATG
GCCCCTGCCCTGCAGCCCACCCAGGGTGCCATGCCGGCCTTCGCCTCTGCTTTCCAGCGCCGGGCA
GGAGGGGTCCTGGTTGCTAGCCATCTGCAGAGCTTCCTGGAGGTGTCGTACCGCGTTCTACGCCAC
CTTGCGCAGCCG SEQ ID NO:304
pMON39909.seq GCTGATGAAGAACTGTGTGGTGGTCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGTACGTAGAGGGCGGTGGAGGCTCCCGGGTGGTGGTTCTGGCGGC
GGCTCCAACATGGCTACTCAAGGTGCTATGCCAGCTTTTGCTTCTGCTTTTCAACGTCGTGCAGGT
GGTGTTCTGGTTGCTAGCCATCTGCAGAGCTTCCTGGAGGTGTCGTACCGCGTTCTACGCCACCTT
GCGCAGCCCTCTGGCGGCTCTGGCGGCTCTCAGAGCTTCCTGCTCAAGTCTTTAGAGCAAGTGAGA
AAGATCCAGGGCGATGGCGCAGCGCTCCAGGAGAAGCTGTGTGCCACCTACAAGCTGTGCCACCCC
GAGGAGCTGGTGCTGCTCGGACACTCTCTGGGCATCCCCTGGGCTCCCCTGAGCTCCTGCCCCAGC
CAGGCCCTGCAGCTGGCAGGCTGCTTGAGCCAACTCCATAGCGGCCTTTTCCTCTACCAGGGGCTC
CTGCAGGCCCTGGAAGGGATATCCCCCGAGTTGGGTCCCACCTTGGACACACTGCAGCTGGACGTC
GCCGACTTTGCCACCACCATCTGGCAGCAGATGGAAGAACTGGGAATGGCCCCTGCCCTGCAGCCC
SEQ ID NO:305
pMON39910.seq GCTACTCAAGGTGCTATGCCAGCTTTTGCTTCTGCTTTTCAACGTCGTGCAGGTGGTGTTCTGGTT
GCTAGCCATCTGCAGAGCTTCCTGGAGGTGTCGTACCGCGTTCTACGCCACCTTGCGCAGCCCTCT
GGCGGCTCTGGCGGCTCTCAGAGCTTCCTGCTCAAGTCTTTAGAGCAAGTGAGAAAGATCCAGGGC
GATGGCGCAGCGCTCCAGGAGAAGCTGTGTGCCACCTACAAGCTGTGCCACCCCGAGGAGCTGGTG
CTGCTCGGACACTCTCTGGGCATCCCCTGGGCTCCCCTGAGCTCCTGCCCCAGCCAGGCCCTGCAG
CTGGCAGGCTGCTTGAGCCAACTCCATAGCGGCCTTTTCCTCTACCAGGGGCTCCTGCAGGCCCTG
GAAGGGATATCCCCCGAGTTGGGTCCCACCTTGGACACACTGCAGCTGGACGTCGCCGACTTTGCC
ACCACCATCTGGCAGCAGATGGAAGAACTGGGAATGGCCCCTGCCCTGCAGCCCTACGTAGAGGGC
GGTGGAGGCTCCCGGGTGAACCGTCTGGTCCAATCTCTACTATCAACCCGTCTCCTCCGTCTAAA
GAATCTCATAAATCTCCAAACATGGCCGACGAGGAGCTCTGCGGGGGCCTCTGGCGGCTGGTCCTG
GCACAGCGCTGGATGGAGCGGCTCAAGACTGTCGCTGGGTCCAAGATGCAAGGCTTGCTGGAGCGC
GTGAACACGGAGATACACTTTGTCACCAAATGTGCCTTTCAGCCCCCCCCCAGCTGTCTTCGCTTC
GTCCAGACCAACATCTCCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGACTCCTCAACCCTGGGC
GGTGGGTCAGGAGGTGGGTCAGGAGGTGGATCCGGAGGTGGCTCAGGGGGAGGTAGTGGTACCCAG
GACTGCTCCTTCCAACACAGCCCCATCTCCTCCGACTTCGCTGTCAAAATCCGTGAGCTGTCTGAC
TACCTGCTTCAAGATTACCCAGTCACCGTGGCCTCCAACCTGCAG SEQ ID NO:306

TABLE 2-continued

GENE SEQUENCES pMON35727.seq

GCCGACGAGGAGCTGTGCGGTGGCCTCTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGAACCCAGGACTGCTCCTTCCAACACAGCCCCATCTCCTCCGACTTCGCT
GTCAAAATCCGTGAGCTGTCTGACTACCTGCTTCAAGATTACCCAGTCACCGTGGCCTCCAACCTG
CAGTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCCGACGAGGAGCTCTGCGGGGGCCTC
TGGCGGCTGGTCCTGGCACAGCGCTGGATGGAGCGGCTCAAGACTGTCGCTGGGTCCAAGATGCAA
GGCTTGCTGGAGCGCGTGAACACGGAGATACACTTTGTCACCAAATGTGCCTTTCAGCCCCCCCCC
AGCTGTCTTCGCTTCGTCCAGACCAACATCTCCCGCCTCCTGCAGGAGACCTCCGAGCAGCTGGTG
GCGCTGAAGCCCTGGATCACTCGCCAGAACTTCTCCCGGTGCCTGGAGCTGCAGTGTCAGCCCGAC
TCCTCAACCCTGGGCGGTGGGTCAGGAGGTGGGTCAGGAGGTGGATCCGGAGGTGGCACCCAGGAC
TGCTCCTTCCAACACAGCCCCATCTCCTCCGACTTCGCTGTCAAAATCCGTGAGCTGTGCTGACTAC
CTGCTTCAAGATTACCCAGTCACCGTGGCCTCCAACCTGCAG SEQ ID:307 pMON32168.seq

GCTGATGAAGAACTGTGTGGTGGTCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGTACGTAGAGGGCGGTGGAGGCTCCCCGGGTGAACCGTCTGGTCCA
ATCTCTACTATCAACCCGTCTCCTCCGTCTAAAGAATCTCATAAATCTCCAAACATGGCTACCCAG
GACTGCTCCTTCCAACACAGCCCCATCTCCTCCGACTTCGCTGTCAAAATCCGTGAGCTGTCTGAC
TACCTGCTTCAAAATTACCCAGTCACCGTGGCCTCCAACCTGCAGGACGAGGAGCTCTGCGGGGGC
CTCTGGCGGCTGGTCCTGGCACAGCGCTGGATGGAGCGGCTCAAGACTGTCGCTGGGTCCAAGATG
CAAGGCTTGCTGGAGCGCGTGAACACGGAGATACACTTTGTCACCAAATGTGCCTTTCAGCCCCCC
CCCAGCTGTCTTCGCTTCGTCCAGACCAACATCTCCCGCCTCCTGCAGGAGACCTCCGAGCAGCTG
GTGGCGCTGAAGCCCTGGATCACTCGCCAGAACTTCTCCCGGTGCCTGGAGCTGCAGTGTCAGCCC
GACTCCTCAACCCTG SEQ ID NO:308 pMON32195.seq

GCTGATGAAGAACTGTGTGGTGGTCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGTACGTAGAGGGCGGTGGAGGCTCCCCGGGTGGTGGTTCTGGCGGC
GGCTCCAACATGGCTACACCATTGGGCCCTGCCAGCTCCTGCCCCAGAGCTTCCTGCTCAAGTCT
TTAGAGCAAGTGAGAAAGATCCAGGGCGATGGCGCAGCGCTCCAGGAGAAGCTGTGTGCCACCTAC
AAGCTGTGCCACCCCGAGGAGCTGGTGCTGCTCGGACACTCTCTGGGCATCCCCTGGGCTCCCCTG
AGCTCCTGCCCCAGCCAGGCCCTGCAGCTGGCAGGCTGCTTGAGCCAACTCCATAGCGGCCTTTTC
CTCTACCAGGGGCTCCTGCAGGCCCTGGAAGGGATATCCCCCGAGTTGGGTCCCACCTTGGACACA
CTGCAGCTGGACGTCGCCGACTTTGCCACCACCATCTGGCAGCAGATGGAAGAACTGGGAATGGCC
CCTGCCCTGCAGCCCACCCAGGGTGCCATGCCGGCCTTCGCCTCTGCTTTCCAGCGCCGGGCAGGA
GGGGTCCTGGTTGCTAGCCATCTGCAGAGCTTCCTGGAGGTGTCGTACCGCGTTCTACGCCACCTT
GCGCAGCCCTACGTAGAGGGCGGTGGAGGCTCCCCGGGTGAACCGTCTGGTCCAATCTCTACTATC
AACCCGTCTCCTCCGTCTAAAGAATCTCATAAATCTCCAAACATGGCTGATGAAGAACTGTGTGGT
GGTCTGTGGCGGCTGGTCCTGGCACAGCGCTGGATGGAGCGGCTCAAGACTGTCGCTGGGTCCAAG
ATGCAAGGCTTGCTGGAGCGCGTGAACACGGAGATACACTTTGTCACCAAATGTGCCTTTCAGCCC
CCCCCCAGCTGTCTTCGCTTCGTCCAGACCAACATCTCCCGCCTCCTGCAGGAGACCTCCGAGCAG
CTGGTGGCGCTGAAGCCCTGGATCACTCGCCAGAACTTCTCCCGGTGCCTGGAGCTGCAGTGTCAG
CCCGACTCCTCAACCCTGGGCGGTGGGTCAGGAGGTGGGTCAGGAGGTGGATCCGGAGGTGGCTCA
GGGGGAGGTAGTGGTACCCAGGACTGCTCCTTCCAACACAGCCCCATCTCCTCCGACTTCGCTGTC
AAAATCCGTGAGCTGTCTGACTACCTGCTTCAAGATTACCCAGTCACCGTGGCCTCCAACCTGCAG
SEQ ID NO:309 pMON32196.seq

GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCTGATGAAGAACTGTGTGGTGGTCTGTGGCGG
CTGGTCCTGGCACAGCGCTGGATGGAGCGGCTCAAGACTGTCGCTGGGTCCAAGATGCAAGGCTTG

TABLE 2-continued

GENE SEQUENCES

CTGGAGCGCGTGAACACGGAGATACACTTTGTCACCAAATGTGCCTTTCAGCCCCCCCCAGCTGT
CTTCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCAGCCCGACTCCTCA
ACCCTGGGCGGTGGGTCAGGAGGTGGGTCAGGAGGTGGATCCGGAGGTGGCTCAGGGGGAGGTAGT
GGTACCCAGGACTGCTCCTTCCAACACAGCCCCATCTCCTCCGACTTCGCTGTCAAAATCCGTGAG
CTGTCTGACTACCTGCTTCAAGATTACCCAGTCACCGTGGCCTCCAACCTGCAGTACGTAGAGGGC
GGTGGAGGCTCCCCGGGTGAACCGTCTGGTCCAATCTCTACTATCAACCCGTCTCCTCCGTCTAAA
GAATCTCATAAATCTCCAAACATGGCTACCCAGGACTGCTCCTTCCAACACAGCCCCATCTCCTCC
GACTTCGCTGTCAAAATCCGTGAGCTGTCTGACTACCTGCTTCAAGATTACCCAGTCACCGTGGCC
TCCAACCTGCAGGACGAGGAGCTCTGCGGGGGCCTCTGGCGGCTGGTCCTGGCACAGCGCTGGATG
GAGCGGCTCAAGACTGTCGCTGGGTCCAAGATGCAAGGCTTGCTGGAGCGCGTGAACACGGAGATA
CACTTTGTCACCAAATGTGCCTTTCAGCCCCCCCCAGCTGTCTTCGCTTCGTCCAGACCAACATC
TCCCGCCTCCTGCAGGAGACCTCCGAGCAGCTGGTGGCGCTGAAGCCCTGGATCACTCGCCAGAAC
TTCTCCCGGTGCCTGGAGCTGCAGTGTCAGCCCGACTCCTCAACCCTG SEQ ID NO:310
pMON32197.seq GCTACACCATTGGGCCCTGCCAGCTCCCTGCCCCAGAGCTTCCTGCTCAAGTCTTTAGAGCAAGTG
AGAAAGATCCAGGGCGATGGCGCAGCGCTCCAGGAGAAGCTGTGTGCCACCTACAAGCTGTGCCAC
CCCGAGGAGCTGGTGCTGCTCGGACACTCTCTGGGCATCCCCTGGGCTCCCCTGAGCTCCTGCCCC
AGCCAGGCCCTGCAGCTGGCAGGCTGCTTGAGCCAACTCCATAGCGGCCTTTTCCTCTACCAGGGG
CTCCTGCAGGCCCTGGAAGGGATATCCCCCGAGTTGGGTCCCACCTTGGACACACTGCAGCTGGAC
GTCGCCGACTTTGCCACCACCATCTGGCAGCAGATGGAAGAACTGGGAATGGCCCCTGCCCTGCAG
CCCACCCAGGGTGCCATGCCGGCCTTCGCCTCTGCTTTCCAGCGCCGGGCAGGAGGGGTCCTGGTT
GCTAGCCATCTGCAGAGCTTCCTGGAGGTGTCGTACCGCGTTCTACGCCACCTTGCGCAGCCCTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCTGATGAAGAACTGTGTGGTGGTCTGTGGCGG
CTGGTCCTGGCACAGCGCTGGATGGAGCGGCTCAAGACTGTCGCTGGGTCCAAGATGCAAGGCTTG
CTGGAGCGCGTGAACACGGAGATACACTTTGTCACCAAATGTGCCTTTCAGCCCCCCCCAGCTGT
CTTCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCAGCCCGACTCCTCA
ACCCTGGGCGGTGGGTCAGGAGGTGGGTCAGGAGGTGGATCCGGAGGTGGCTCAGGGGGAGGTAGT
GGTACCCAGGACTGCTCCTTCCAACACAGCCCCATCTCCTCCGACTTCGCTGTCAAAATCCGTGAG
CTGTCTGACTACCTGCTTCAAGATTACCCAGTCACCGTGGCCTCCAACCTGCAGTACGTAGAGGGC
GGTGGAGGCTCCCCGGGTGAACCGTCTGGTCCAATCTCTACTATCAACCCGTCTCCTCCGTCTAAA
GAATCTCATAAATCTCCAAACATGGCTGATGAAGAACTGTGTGGTGGTCTGTGGCGGCTGGTCCTG
GCACAGCGCTGGATGGAGCGGCTCAAGACTGTCGCTGGGTCCAAGATGCAAGGCTTGCTGGAGCGC
GTGAACACGGAGATACACTTTGTCACCAAATGTGCCTTTCAGCCCCCCCCAGCTGTCTTCGCTTC
GTCCAGACCAACATCTCCCGCCTCCTGCAGGAGACCTCCGAGCAGCTGGTGGCGCTGAAGCCCTGG
ATCACTCGCCAGAACTTCTCCCGGTGCCTGGAGCTGCAGTGTCAGCCCGACTCCTCAACCCTGGGC
GGTGGGTCAGGAGGTGGGTCAGGAGGTGGATCCGGAGGTGGCTCAGGGGGAGGTAGTGGTACCCAG
GACTGCTCCTTCCAACACAGCCCCATCTCCTCCGACTTCGCTGTCAAAATCCGTGAGCTGTCTGAC
TACCTGCTTCAAGATTACCCAGTCACCGTGGCCTCCAACCTGCAG SEQ ID NO:311
pMON32206.seq GCTAACTGCTCTATAATGATCGATGAAATTATACATCACTTAAAGAGACCACCTGCACCTTTGCTG
GACCCGAACAACCTCAATGACGAAGACGTCTCTATCCTGATGGACCGAAACCTTCGACTTCCAAAC
CTGGAGAGCTTCGTAAGGGCTGTCAAGAACTTAGAAAATGCATCAGGTATTGAGGCAATTCTTCGT
AATCTCCAACCATGTCTGCCCTCTGCCACGGCCGCACCCTCTCGACATCCAATCATCATCAAGGCA
GGTGACTGGCAAGAATTCCGGGAAAAACTGACGTTCTATCTGGTTACCCTTGAGCAAGCGCAGGAA
CAACAGTACGTAGAGGGCGGTGGAGGCTCCCCGGGTGAACCGTCTGGTCCAATCTCTACTATCAAC
CCGTCTCCTCCGTCTAAAGAATCTCATAAATCTCCAAACATGGCTGATGAAGAACTGTGTGGTGGT
CTGTGGCGGCTGGTCCTGGCACAGCGCTGGATGGAGCGGCTCAAGACTGTCGCTGGGTCCAAGATG
CAAGGCTTGCTGGAGCGCGTGAACACGGAGATACACTTTGTCACCAAATGTGCCTTTCAGCCCCCC
CCCAGCTGTCTTCGCTTCGTCCAGACCAACATCTCCCGCCTCCTGCAGGAGACCTCCGAGCAGCTG
GTGGCGCTGAAGCCCTGGATCACTCGCCAGAACTTCTCCCGGTGCCTGGAGCTGCAGTGTCAGCCC
GACTCCTCAACCCTGGGCGGTGGGTCAGGAGGTGGGTCAGGAGGTGGATCCGGAGGTGGCTCAGGG
GGAGGTAGTGGTACCCAGGACTGCTCCTTCCAACACAGCCCCATCTCCTCCGACTTCGCTGTCAAA
ATCCGTGAGCTGTCTGACTACCTGCTTCAAGATTACCCAGTCACCGTGGCCTCCAACCTGCAGTAC
GTAGAGGGCGGTGGAGGCTCCCCGGGTGAACCGTCTGGTCCAATCTCTACTATCAACCCGTCTCCT
CCGTCTAAAGAATCTCATAAATCTCCAAACATGGCTGATGAAGAACTGTGTGGTGGTCTGTGGCGG
CTGGTCCTGGCACAGCGCTGGATGGAGCGGCTCAAGACTGTCGCTGGGTCCAAGATGCAAGGCTTG
CTGGAGCGCGTGAACACGGAGATACACTTTGTCACCAAATGTGCCTTTCAGCCCCCCCCAGCTGT
CTTCGCTTCGTCCAGACCAACATCTCCCGCCTCCTGCAGGAGACCTCCGAGCAGCTGGTGGCGCTG
AAGCCCTGGATCACTCGCCAGAACTTCTCCCGGTGCCTGGAGCTGCAGTGTCAGCCCGACTCCTCA
ACCCTGGGCGGTGGGTCAGGAGGTGGGTCAGGAGGTGGATCCGGAGGTGGCTCAGGGGGAGGTAGT
GGTACCCAGGACTGCTCCTTCCAACACAGCCCCATCTCCTCCGACTTCGCTGTCAAAATCCGTGAG
CTGTCTGACTACCTGCTTCAAGATTACCCAGTCACCGTGGCCTCCAACCTGCAG SEQ ID
NO:312
pMON32207.seq GCTGATGAAGAACTGTGTGGTGGTCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC

TABLE 2-continued

GENE SEQUENCES

ACCGTGGCCTCCAACCTGCAGTACGTAGAGGGCGGTGGAGGCTCCCCGGGTGGTGGTTCTGGCGGC
GGCTCCAACATGGCTGATGAAGAACTGTGTGGTGGTCTGTGGCGGCTGGTCCTGGCACAGCGCTGG
ATGGAGCGGCTCAAGACTGTCGCTGGGTCCAAGATGCAAGGCTTGCTGGAGCGCGTGAACACGGAG
ATACACTTTGTCACCAAATGTGCCTTTCAGCCCCCCCCCAGCTGTCTTCGCTTCGTCCAGACCAAC
ATCTCCCGCCTCCTGCAGGAGACCTCCGAGCAGCTGGTGGCG.CTGAAGCCCTGGATCACTCGCCAG
AACTTCTCCCGGTGCCTGGAGCTGCAGTGTCAGCCCGACTCCTCAACCCTGGGCGGTGGGTCAGGA
GGTGGGTCAGGAGGTGGATCCGGAGGTGGCTCAGGGGGAGGTAGTGGTACCCAGGACTGCTCCTTC
CAACACAGCCCCATCTCCTCCGACTTCGCTGTCAAAATCCGTGAGCTGTCTGACTACCTGCTTCAA
GATTACCCAGTCACCGTGGCCTCCAACCTGCAGTACGTAGAGGGCGGTGGAGGCTCCCCGGGTGAA
CCGTCTGGTCCAATCTCTACTATCAACCCGTCTCCTCCGTCTAAAGAATCTCATAAATCTCCAAAC
ATGGCTACACCATTAGGCCCTGCCAGCTCCCTGCCCCAGAGCTTCCTGCTCAAGTGCTTAGAGCAA
GTGAGGAAGATCCAGGGCGATGGCGCAGCGCTCCAGGAGAAGCTGTGTGCCACCTACAAGCTGTGC
CACCCCGAGGAGCTGGTGCTGCTCGGACACTCTCTGGGCATCCCCTGGGCTCCCCTGAGCTCCTGC
CCCAGCCAGGCCCTGCAGCTGGCAGGCTGCTTGAGCCAACTCCATAGCGGCCTTTTCCTCTACCAG
GGGCTCCTGCAGGCCCTGGAAGGGATATCCCCCGAGTTGGGCTCCCACCTTGGACACACTGCAGCTG
GACGTCGCCGACTTTGCCACCACCATCTGGCAGCAGATGGAAGAACTGGGAATGGCCCCTGCCCTG
CAGCCCACCCAGGGTGCCATGCCGGCCTTCGCCTCTGCTTTCCAGCGCCGGGCAGGAGGGGTCCTG
GTTGCTAGCCATCTGCAGAGCTTCCTGGAGGTGTCGTACCGCGTTCTACGCCACCTTGCGCAGCCC
TGATAAGGATCCGAATTCGGCAGC SEQ ID NO:313
pMON35728.seq GCCGACGAGGAGCTGTGCGGTGGCCTCTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGAACCCAGGACTGCTCCTTCCAACACAGCCCCATCTCCTCCGACTTCGCT
GTCAAAATCCGTGAGCTGTCTGACTACCTGCTTCAAGATTACCCAGTCACCGTGGCCTCCAACCTG
CAGTACGTAGAGGGCGGTGGAGGCTCCCCGGGTGAACCGTCTGGTCCAATCTCTACTATCAACCCG
TCTCCTCCGTCTAAAGAATCTCATAAATCTCCAAACATGGCTAACTGCTCTATAATGATCGATGAA
ATTATACATCACTTAAAGAGACCACCTAACCCTTTGCTGGACCCGAACAACCTCAATTCTGAAGAC
ATGGATATCCTGATGGAACGAAACCTTCGAACTCCAAACCTGCTCGCATTCGTAAGGGCTGTCAAG
CACTTAGAAAATGCATCAGGTATTGAGGCAATTCTTCGTAATCTCCAACCATGTCTGCCCTCTGCC
ACGGCCGCACCCTCTCGACATCCAATCATCATCAAGGCAGGTGACTGGCAAGAATTCGGGAAAAA
CTGACGTTCTATCTGGTTACCCTTGAGCAAGCGCAGGAACAACAGTACGTAGAGGGCGGTGGAGGC
TCCCCGGGTGAACCGTCTGGTCCAATCTCTACTATCAACCCGTCTCCTCCGTCTAAAGAATCTCAT
AAATCTCCAAACATGGCCGACGAGGAGCTCTGCGGGGGCCTCTGGCGGCTGGTCCTGGCACAGCGC
TGGATGGAGCGGCTCAAGACTGTCGCTGGGTCCAAGATGCAAGGCTTGCTGGAGCGCGTGAACACG
GAGATACACTTTGTCACCAAATGTGCCTTTCAGCCCCCCCCCAGCTGTCTTCGCTTCGTCCAGACC
AACATCTCCCGCCTCCTGCAGGAGACCTCCGAGCAGCTGGTGGCGCTGAAGCCCTGGATCACTCGC
CAGAACTTCTCCCGGTGCCTGGAGCTGCAGTGTCAGCCCGACTCCTCAACCCTGGGCGGTGGGTCA
GGAGGTGGGTCAGGAGGTGGATCCGGAGGTGGCACCCAGGACTGCTCCTTCCAACACAGCCCCATC
TCCTCCGACTTCGCTGTCAAAATCCGTGAGCTGTCTGACTACCTGCTTCAAGATTACCCAGTCACC
GTGGCCTCCAACCTGCAG SEQ ID NO:314
pMON32183.seq GCTGATGAAGAACTGTGTGGTGGTCTGTGGCGGCTGGTCCTGGCACAGCGCTGGATGGAGCGGCTC
AAGACTGTCGCTGGGTCCAAGATGCAAGGCTTGCTGGAGCGCGTGAACACGGAGATACACTTTGTC
ACCAAATGTGCCTTTCAGCCCCCCCCCAGCTGTCTTCGCTTCGTCCAGACCAACATCTCCCGCCTC
CTGCAGGAGACCTCCGAGCAGCTGGTGGCGCTGAAGCCCTGGATCACTCGCCAGAACTTCTCCCGG
TGCCTGGAGCTGCAGTGTCAGCCCGACTCCTCAACCCTGGGCGGTGGGTCAGGAGGTGGGTCAGGA
GGTGGATCCGGAGGTGGCTCAGGGGGAGGTAGTGGTACCCAGGACTGCTCCTTCCAACACAGCCCC
ATCTCCTCCGACTTCGCTGTCAAAATCCGTGAGCTGTCTGACTACCTGCTTCAAGATTACCCAGTC
ACCGTGGCCTCCAACCTGCAGGAATTCAAGCTTGAGCCCAGAGGGCCCACAATCAAGCCCTGTCCT
CCATGCAAATGCCCAGCACCTAACCTCTTGGGTGGACCATCCGTCTTCATCTTCCCTCCAAAGATC
AAGGATGTACTCATGATCTCCCTGAGCCCCATAGTCACATGTGGTGGTGGATGTGAGCGAGGAT
GACCCAGATGTCCAGATCAGCTGGTTTGTGAACAACGTGGAAGTACACACAGCTCAGACACAAACC
CATAGAGAGGATTACAACAGTACTCTCCGGCGGTCAGTGCCCTCCCCATCCAGCACCAGGACTGG
ATGAGTGGCAAGGAGTTCAAATGCAAGGTCAACAACAAAGACCTCCCAGCGCCCATCGAGAGAACC
ATCTCAAAACCCAAAGGGTCAGTAAGAGCTCCACAGGTATATGTCTTGCCTCCACCAGAAGAAGAG
ATGACTAAGAAACAGGTCACTCTGACCTGCATGGTCACAGACTTCATGCCTGAAGACATTTACGTG
GAGTGGACCAACAACGGGAAAACAGAGCTAAACTACAAGAACACTGAACCAGTCCTGGACTCTGAT
GGTTCTTACTTCATGTACAGCAAGCTGAGAGTGGAAAAGAAGAACTGGGTGGAAAGAAATAGCTAC
TCCTGTTCAGTGGTCCACGAGGGTCTGCACAATCACCACACGACTAAGAGCTTCTCCCGGACTCCG
GGTAAA SEQ ID NO:315
pMON32184.seq GCCACCCAGGACTGCTCCTTTCAACACAGCCCCATCTCCTCCGACTTCGCTGTCAAAATCCGTGAG
CTGTCTGACTACCTGCTTCAAGATTACCCAGTCACCGTGGCCTCCAACCTGCAGGACGAGGAGCTC
TGCGGGGGCCTCTGGCGGCTGGTCCTGGCACAGCGCTGGATGGAGCGGCTCAAGACTGTCGCTGGG
TCCAAGATGCAAGGCTTGCTGGAGCGCGTGAACACGGAGATACACTTTGTCACCAAATGTGCCTTT
CAGCCCCCCCCCAGCTGTCTTCGCTTCGTCCAGACCAACATCTCCCGCCTCCTGCAGGAGACCTCC
GAGCAGCTGGTGGCGCTGAAGCCCTGGATCACTCGCCAGAACTTCTCCCGGTGCCTGGAGCTGCAG
TGTCAGCCCGACTCCTCAACCCTGGAATTCAAGCTTGAGCCCAGAGGGCCCACAATCAAGCCCTGT
CCTCCATGCAAATGCCCAGCACCTAACCTCTTGGGTGGACCATCCGTCTTCATCTTCCCTCCAAAG
ATCAAGGATGTACTCATGATCTCCCTGAGCCCCATAGTCACATGTGTGGTGGTGGATGTGAGCGAG
GATGACCCAGATGTCCAGATCAGCTGGTTTGTGAACAACGTGGAAGTACACACAGCTCAGACACAA

TABLE 2-continued

GENE SEQUENCES

ACCCATAGAGAGGATTACAACAGTACTCTCCGGGCGGTCAGTGCCCTCCCCATCCAGCACCAGGAC
TGGATGAGTGGCAAGGAGTTCAAATGCAAGGTCAACAACAAAGACCTCCCAGCGCCCATCGAGAGA
ACCATCTCAAAACCCAAAGGGTCAGTAAGAGCTCCACAGGTATATGTCTTGCCTCCACCAGAAGAA
GAGATGACTAAGAAACAGGTCACTCTGACCTGCATGGTCACAGACTTCATGCCTGAAGACATTTAC
GTGGAGTGGACCAACAACGGGAAAACAGAGCTAAACTACAAGAACACTGAACCAGTCCTGGACTCT
GATGGTTCTTACTTCATGTACAGCAAGCTGAGAGTGGAAAAGAAGAACTGGGTGGAAAGAAATAGC
TACTCCTGTTCAGTGGTCCACGAGGGTCTGCACAATCACCACACGACTAAGAGCTTCTCCCGGACT
CCGGGTAAA SEQ ID NO:316

TABLE 3

PROTEIN SEQUENCES pMON26458pep

SerProAlaProProAlaCysAspLeuArgValLeuSerLysLeuLeuArgAspSerHis
ValLeuHisSerArgLeuSerGlnCysProGluValHisProLeuProThrProValLeu
LeuProAlaValAspPheSerLeuGlyGluTrpLysThrGlnMetGluGluThrLysAla
GlnAspIleLeuGlyAlaValThrLeuLeuLeuGluGlyValMetAlaAlaArgGlyGln
LeuGlyProThrCysLeuSerSerLeuLeuGlyGlnLeuSerGlyGlnValArgLeuLeu
LeuGlyAlaLeuGlnSerLeuLeuGlyThrGlnLeuProProGlnGlyArgThrThrAla
HisLysAspProAsnAlaIlePheLeuSerPheGlnHisLeuLeuArgGlyLysValArg
PheLeuMetLeuValGlyGlySerThrLeuCysValArgGluPhe SEQ ID NO:467 pMON28548pep

SerProAlaProProAlaCysAspLeuArgValLeuSerLysLeuLeuArgAspSerHis
ValLeuHisSerArgLeuSerGlnCysProGluValHisProLeuProThrProValLeu
LeuProAlaValAspPheSerLeuGlyGluTrpLysThrGlnMetGluGluThrLysAla
GlnAspIleLeuGlyAlaValThrLeuLeuLeuGluGlyValMetAlaAlaArgGlyGln
LeuGlyProThrCysLeuSerSerLeuLeuGlyGlnLeuSerGlyGlnValArgLeuLeu
LeuGlyAlaLeuGlnSerLeuLeuGlyThrGlnLeuProProGlnGlyArgThrThrAla
HisLysAspProAsnAlaIlePheLeuSerPheGlnHisLeuLeuArgGlyLysValArg
PheLeuMetLeuValGlyGlySerThrLeuCysValArgGluPheGlyGlyAsnMetAla
SerProAlaProProAlaCysAspLeuArgValLeuSerLysLeuLeuArgAspSerHis
ValLeuHisSerArgLeuSerGlnCysProGluValHisProLeuProThrProValLeu
LeuProAlaValAspPheSerLeuGlyGluTrpLysThrGlnMetGluGluThrLysAla
GlnAspIleLeuGlyAlaValThrLeuLeuLeuGluGlyValMetAlaAlaArgGlyGln
LeuGlyProThrCysLeuSerSerLeuLeuGlyGlnLeuSerGlyGlnValArgLeuLeu
LeuGlyAlaLeuGlnSerLeuLeuGlyThrGlnLeuProProGlnGlyArgThrThrAlaHisLysAspPro
AsnAlaIlePheLeuSerPheGlnHisLeuLeuArgGlyLysValArgPheLeuMetLeu
ValGlyGlySerThrLeuCysValArg SEQ ID NO:468 pMON28500

SerProAlaProProAlaCysAspLeuArgValLeuSerLysLeuLeuArgAspSerHis
ValLeuHisSerArgLeuSerGlnCysProGluValHisProLeuProThrProValLeu
LeuProAlaValAspPheSerLeuGlyGluTrpLysThrGlnMetGluGluThrLysAla
GlnAspIleLeuGlyAlaValThrLeuLeuLeuGluGlyValMetAlaAlaArgGlyGln
LeuGlyProThrCysLeuSerSerLeuLeuGlyGlnLeuSerGlyGlnValArgLeuLeu
LeuGlyAlaLeuGlnSerLeuLeuGlyThrGlnLeuProProGlnGlyArgThrThrAla
HisLysAspProAsnAlaIlePheLeuSerPheGlnHisLeuLeuArgGlyLysValArg
PheLeuMetLeuValGlyGlySerThrLeuCysValArgGluPheGlyGlyAsnMetAlaSer
ProAlaProProAlaCysAspLeuArgValLeuSerLysLeuLeuArgAspSerHisVal
LeuHisSerArgLeuSerGlnCysProGluValHisProLeuProThrProValLeuLeu
ProAlaValAspPheSerLeuGlyGluTrpLysThrGlnMetGluGluThrLysAlaGln
AspIleLeuGlyAlaValThrLeuLeuLeuGluGlyValMetAlaAlaArgGlyGlnLeu
GlyProThrCysLeuSerSerLeuLeuGlyGlnLeuSerGlyGlnValArgLeuLeuLeu
GlyAlaLeuGlnSerLeuLeuGlyThrGlnLeuProProGlnGlyArgThrThrAlaHis
LysAspProAsnAlaIlePheLeuSerPheGlnHisLeuLeuArgGlyLysValArgPhe
LeuMetLeuValGlyGlySerThrLeuCysValArg SEQ ID NO:469 pMON28501

SerProAlaProProAlaCysAspLeuArgValLeuSerLysLeuLeuArgAspSerHis
ValLeuHisSerArgLeuSerGlnCysProGluValHisProLeuProThrProValLeu
LeuProAlaValAspPheSerLeuGlyGluTrpLysThrGlnMetGluGluThrLysAla
GlnAspIleLeuGlyAlaValThrLeuLeuLeuGluGlyValMetAlaAlaArgGlyGln
LeuGlyProThrCysLeuSerSerLeuLeuGlyGlnLeuSerGlyGlnValArgLeuLeu
LeuGlyAlaLeuGlnSerLeuLeuGlyThrGlnLeuProProGlnGlyArgThrThrAla
HisLysAspProAsnAlaIlePheLeuSerPheGlnHisLeuLeuArgGlyLysValArg
PheLeuMetLeuValGlyGlySerThrLeuCysValArgGluPheGlyGlyAsnMetAla
SerProAlaProProAlaCysAspLeuArgValLeuSerLysLeuLeuArgAspSerHis
ValLeuHisSerArgLeuSerGlnCysProGluValHisProLeuProThrProValLeu

TABLE 3-continued

PROTEIN SEQUENCES

LeuProAlaValAspPheSerLeuGlyGluTrpLysThrGlnMetGluGluThrLysAla
GlnAspIleLeuGlyAlaValThrLeuLeuLeuGluGlyValMetAlaAlaArgGlyGln
LeuGlyProThrCysLeuSerSerLeuLeuGlyGlnLeuSerGlyGlnValArgLeuLeu
LeuGlyAlaLeuGlnSerLeuLeuGlyThrGlnLeuProProGlnGlyArgThrThrAla
HisLysAspProAsnAlaIlePheLeuSerPheGlnHisLeuLeuArgGlyLysValArg
PheLeuMetLeuValGlyGlySerThrLeuCysValArg SEQ ID NO:470 pMON28502

SerProAlaProProAlaCysAspLeuArgValLeuSerLysLeuLeuArgAspSerHis
ValLeuHisSerArgLeuSerGlnCysProGluValHisProLeuProThrProValLeu
LeuProAlaValAspPheSerLeuGlyGluTrpLysThrGlnMetGluGluThrLysAla
GlnAspIleLeuGlyAlaValThrLeuLeuLeuGluGlyValMetAlaAlaArgGlyGln
LeuGlyProThrCysLeuSerSerLeuLeuGlyGlnLeuSerGlyGlnValArgLeuLeu
LeuGlyAlaLeuGlnSerLeuLeuGlyThrGlnLeuProProGlnGlyArgThrThrAla
HisLysAspProAsnAlaIlePheLeuSerPheGlnHisLeuLeuArgGlyLysValArg
PheLeuMetLeuValGlyGlySerThrLeuCysValArgGluPheGlyGlyAsnGlyGly
AsnMetAlaSerProAlaProProAlaCysAspLeuArgValLeuSerLysLeuLeuArg
AspSerHisValLeuHisSerArgLeuSerGlnCysProGluValHisProLeuProThr
ProValLeuLeuProAlaValAspPheSerLeuGlyGluTrpLysThrGlnMetGluGlu
ThrLysAlaGlnAspIleLeuGlyAlaValThrLeuLeuLeuGluGlyValMetAlaAla
ArgGlyGlnLeuGlyProThrCysLeuSerSerLeuLeuGlyGlnLeuSerGlyGlnVal
ArgLeuLeuLeuGlyAlaLeuGlnSerLeuLeuGlyThrGlnLeuProProGlnGlyArg
ThrThrAlaHisLysAspProAsnAlaIlePheLeuSerPheGlnHisLeuLeuArgGly
LysValArgPheLeuMetLeuValGlyGlySerThrLeuCysValArg SEQ ID NO:471

13182.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Tyr Lys Leu Cys
His Pro Glu Glu Leu Val Leu Leu Gly His Ser Leu Gly Ile Pro
Trp Ala Pro Leu Ser Ser Cys Pro Ser Gln Ala Leu Gln Leu Ala
Gly Cys Leu Ser Gln Leu His Ser Gly Leu Phe Leu Tyr Gln Gly
Leu Leu Gln Ala Leu Glu Gly Ile Ser Pro Glu Leu Gly Pro Thr
Leu Asp Thr Leu Gln Leu Asp Val Ala Asp Phe Ala Thr Thr Ile
Trp Gln Gln Met Glu Glu Leu Gly Met Ala Pro Ala Leu Gln Pro
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Ser Gly Gly
Ser Gly Gly Ser Gln Ser Phe Leu Leu Lys Ser Leu Glu Gln Val
Arg Lys Ile Gln Gly Asp Gly Ala Ala Leu Gln Glu Lys Leu Cys
Ala Thr SEQ ID NO:472

13183.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Tyr Lys Leu Cys
His Pro Glu Glu Leu Val Leu Leu Gly His Ser Leu Gly Ile Pro
Trp Ala Pro Leu Ser Ser Cys Pro Ser Gln Ala Leu Gln Leu Ala
Gly Cys Leu Ser Gln Leu His Ser Gly Leu Phe Leu Tyr Gln Gly
Leu Leu Gln Ala Leu Glu Gly Ile Ser Pro Glu Leu Gly Pro Thr
Leu Asp Thr Leu Gln Leu Asp Val Ala Asp Phe Ala Thr Thr Ile
Trp Gln Gln Met Glu Glu Leu Gly Met Ala Pro Ala Leu Gln Pro
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Ser Gly Gly
Ser Gly Gly Ser Gln Ser Phe Leu Leu Lys Ser Leu Glu Gln Val
Arg Lys Ile Gln Gly Asp Gly Ala Ala Leu Gln Glu Lys Leu Cys
Ala Thr SEQ ID NO:473

TABLE 3-continued

PROTEIN SEQUENCES

13184.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Ser Pro
Gly Gly Gly Ser Gly Gly Ser Asn Met Ala Pro Glu Leu Gly
Pro Thr Leu Asp Thr Leu Gln Leu Asp Val Ala Asp Phe Ala Thr
Thr Ile Trp Gln Gln Met Glu Glu Leu Gly Met Ala Pro Ala Leu
Gln Pro Thr Gln Gly Ala Met Pro Ala Phe Ala Ser Ala Phe Gln
Arg Arg Ala Gly Gly Val Leu Val Ala Ser His Leu Gln Ser Phe
Leu Glu Val Ser Tyr Arg Val Leu Arg His Leu Ala Gln Pro Ser
Gly Gly Ser Gly Gly Ser Gln Ser Phe Leu Leu Lys Ser Leu Glu
Gln Val Arg Lys Ile Gln Gly Asp Gly Ala Ala Leu Gln Glu Lys
Leu Cys Ala Thr Tyr Lys Leu Cys His Pro Glu Glu Leu Val Leu
Leu Gly His Ser Leu Gly Ile Pro Trp Ala Pro Leu Ser Ser Cys
Pro Ser Gln Ala Leu Gln Leu Ala Gly Cys Leu Ser Gln Leu His
Ser Gly Leu Phe Leu Tyr Gln Gly Leu Leu Gln Ala Leu Glu Gly
Ile Ser SEQ ID NO:474

13185.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Pro Glu Leu Gly
Pro Thr Leu Asp Thr Leu Gln Leu Asp Val Ala Asp Phe Ala Thr
Thr Ile Trp Gln Gln Met Glu Glu Leu Gly Met Ala Pro Ala Leu
Gln Pro Thr Gln Gly Ala Met Pro Ala Phe Ala Ser Ala Phe Gln
Arg Arg Ala Gly Gly Val Leu Val Ala Ser His Leu Gln Ser Phe
Leu Glu Val Ser Tyr Arg Val Leu Arg His Leu Ala Gln Pro Ser
Gly Gly Ser Gly Gly Ser Gln Ser Phe Leu Leu Lys Ser Leu Glu
Gln Val Arg Lys Ile Gln Gly Asp Gly Ala Ala Leu Gln Glu Lys
Leu Cys Ala Thr Tyr Lys Leu Cys His Pro Glu Glu Leu Val Leu
Leu Gly His Ser Leu Gly Ile Pro Trp Ala Pro Leu Ser Ser Cys
Pro Ser Gln Ala Leu Gln Leu Ala Gly Cys Leu Ser Gln Leu His
Ser Gly Leu Phe Leu Tyr Gln Gly Leu Leu Gln Ala Leu Glu Gly
Ile Ser SEQ ID NO:475

13186.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Met Ala Pro Ala
Leu Gln Pro Thr Gln Gly Ala Met Pro Ala Phe Ala Ser Ala Phe
Gln Arg Arg Ala Gly Gly Val Leu Val Ala Ser His Leu Gln Ser
Phe Leu Glu Val Ser Tyr Arg Val Leu Arg His Leu Ala Gln Pro
Ser Gly Gly Ser Gly Gly Ser Gln Ser Phe Leu Leu Lys Ser Leu
Glu Gln Val Arg Lys Ile Gln Gly Asp Gly Ala Ala Leu Gln Glu
Lys Leu Cys Ala Thr Tyr Lys Leu Cys His Pro Glu Glu Leu Val
Leu Leu Gly His Ser Leu Gly Ile Pro Trp Ala Pro Leu Ser Ser
Cys Pro Ser Gln Ala Leu Gln Leu Ala Gly Cys Leu Ser Gln Leu
His Ser Gly Leu Phe Leu Tyr Gln Gly Leu Leu Gln Ala Leu Glu
Gly Ile Ser Pro Glu Leu Gly Pro Thr Leu Asp Thr Leu Gln Leu
Asp Val Ala Asp Phe Ala Thr Thr Ile Trp Gln Gln Met Glu Glu
Leu Gly SEQ ID NO:476

13187.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp

TABLE 3-continued

PROTEIN SEQUENCES

Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Met Ala Pro Ala
Leu Gln Pro Thr Gln Gly Ala Met Pro Ala Phe Ala Ser Ala Phe
Gln Arg Arg Ala Gly Gly Val Leu Val Ala Ser His Leu Gln Ser
Phe Leu Glu Val Ser Tyr Arg Val Leu Arg His Leu Ala Gln Pro
Ser Gly Gly Ser Gly Gly Ser Gln Ser Phe Leu Leu Lys Ser Leu
Glu Gln Val Arg Lys Ile Gln Gly Asp Gly Ala Ala Leu Gln Glu
Lys Leu Cys Ala Thr Tyr Lys Leu Cys His Pro Glu Glu Leu Val
Leu Leu Gly His Ser Leu Gly Ile Pro Trp Ala Pro Leu Ser Ser
Cys Pro Ser Gln Ala Leu Gln Leu Ala Gly Cys Leu Ser Gln Leu
His Ser Gly Leu Phe Leu Tyr Gln Gly Leu Leu Gln Ala Leu Glu
Gly Ile Ser Pro Glu Leu Gly Pro Thr Leu Asp Thr Leu Gln Leu
Asp Val Ala Asp Phe Ala Thr Thr Ile Trp Gln Gln Met Glu Glu
Leu Gly SEQ ID NO:477

13188.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Thr Gln Gly Ala
Met Pro Ala Phe Ala Ser Ala Phe Gln Arg Arg Ala Gly Gly Val
Leu Val Ala Ser His Leu Gln Ser Phe Leu Glu Val Ser Tyr Arg
Val Leu Arg His Leu Ala Gln Pro Ser Gly Gly Ser Gly Gly Ser
Gln Ser Phe Leu Leu Lys Ser Leu Glu Gln Val Arg Lys Ile Gln
Gly Asp Gly Ala Ala Leu Gln Glu Lys Leu Cys Ala Thr Tyr Lys
Leu Cys His Pro Glu Glu Leu Val Leu Leu Gly His Ser Leu Gly
Ile Pro Trp Ala Pro Leu Ser Ser Cys Pro Ser Gln Ala Leu Gln
Leu Ala Gly Cys Leu Ser Gln Leu His Ser Gly Leu Phe Leu Tyr
Gln Gly Leu Leu Gln Ala Leu Glu Gly Ile Ser Pro Glu Leu Gly
Pro Thr Leu Asp Thr Leu Gln Leu Asp Val Ala Asp Phe Ala Thr
Thr Ile Trp Gln Gln Met Glu Glu Leu Gly Met Ala Pro Ala Leu
Gln Pro SEQ ID NO:478

13189.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Thr Gln Gly Ala
Met Pro Ala Phe Ala Ser Ala Phe Gln Arg Arg Ala Gly Gly Val
Leu Val Ala Ser His Leu Gln Ser Phe Leu Glu Val Ser Tyr Arg
Val Leu Arg His Leu Ala Gln Pro Ser Gly Gly Ser Gly Gly Ser
Gln Ser Phe Leu Leu Lys Ser Leu Glu Gln Val Arg Lys Ile Gln
Gly Asp Gly Ala Ala Leu Gln Glu Lys Leu Cys Ala Thr Tyr Lys
Leu Cys His Pro Glu Glu Leu Val Leu Leu Gly His Ser Leu Gly
Ile Pro Trp Ala Pro Leu Ser Ser Cys Pro Ser Gln Ala Leu Gln
Leu Ala Gly Cys Leu Ser Gln Leu His Ser Gly Leu Phe Leu Tyr
Gln Gly Leu Leu Gln Ala Leu Glu Gly Ile Ser Pro Glu Leu Gly
Pro Thr Leu Asp Thr Leu Gln Leu Asp Val Ala Asp Phe Ala Thr
Thr Ile Trp Gln Gln Met Glu Glu Leu Gly Met Ala Pro Ala Leu
Gln Pro SEQ ID NO:479

13190.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr

TABLE 3-continued

PROTEIN SEQUENCES

Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Ser Ala Phe Gln
Arg Arg Ala Gly Gly Val Leu Val Ala Ser His Leu Gln Ser Phe
Leu Glu Val Ser Tyr Arg Val Leu Arg His Leu Ala Gln Pro Ser
Gly Gly Ser Gly Gly Ser Gln Ser Phe Leu Leu Lys Ser Leu Glu
Gln Val Arg Lys Ile Gln Gly Asp Gly Ala Ala Leu Gln Glu Lys
Leu Cys Ala Thr Tyr Lys Leu Cys His Pro Glu Glu Leu Val Leu
Leu Gly His Ser Leu Gly Ile Pro Trp Ala Pro Leu Ser Ser Cys
Pro Ser Gln Ala Leu Gln Leu Ala Gly Cys Leu Ser Gln Leu His
Ser Gly Leu Phe Leu Tyr Gln Gly Leu Leu Gln Ala Leu Glu Gly
Ile Ser Pro Glu Leu Gly Pro Thr Leu Asp Thr Leu Gln Leu Asp
Val Ala Asp Phe Ala Thr Thr Ile Trp Gln Gln Met Glu Glu Leu
Gly Met Ala Pro Ala Leu Gln Pro Thr Gln Gly Ala Met Pro Ala
Phe Ala SEQ ID NO:480

13191.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Ser Ala Phe Gln
Arg Arg Ala Gly Gly Val Leu Val Ala Ser His Leu Gln Ser Phe
Leu Glu Val Ser Tyr Arg Val Leu Arg His Leu Ala Gln Pro Ser
Gly Gly Ser Gly Gly Ser Gln Ser Phe Leu Leu Lys Ser Leu Glu
Gln Val Arg Lys Ile Gln Gly Asp Gly Ala Ala Leu Gln Glu Lys
Leu Cys Ala Thr Tyr Lys Leu Cys His Pro Glu Glu Leu Val Leu
Leu Gly His Ser Leu Gly Ile Pro Trp Ala Pro Leu Ser Ser Cys
Pro Ser Gln Ala Leu Gln Leu Ala Gly Cys Leu Ser Gln Leu His
Ser Gly Leu Phe Leu Tyr Gln Gly Leu Leu Gln Ala Leu Glu Gly
Ile Ser Pro Glu Leu Gly Pro Thr Leu Asp Thr Leu Gln Leu Asp
Val Ala Asp Phe Ala Thr Thr Ile Trp Gln Gln Met Glu Glu Leu
Gly Met Ala Pro Ala Leu Gln Pro Thr Gln Gly Ala Met Pro Ala
Phe Ala SEQ ID NO:481

13192.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Tyr Lys Leu Cys
His Pro Glu Glu Leu Val Leu Leu Gly His Ser Leu Gly Ile Pro
Trp Ala Pro Leu Ser Ser Cys Pro Ser Gln Ala Leu Gln Leu Ala
Gly Cys Leu Ser Gln Leu His Ser Gly Leu Phe Leu Tyr Gln Gly
Leu Leu Gln Ala Leu Glu Gly Ile Ser Pro Glu Leu Gly Pro Thr
Leu Asp Thr Leu Gln Leu Asp Val Ala Asp Phe Ala Thr Thr Ile
Trp Gln Gln Met Glu Glu Leu Gly Met Ala Pro Ala Leu Gln Pro
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Thr Pro Leu
Gly Pro Ala Ser Ser Leu Pro Gln Ser Phe Leu Leu Lys Ser Leu
Glu Gln Val Arg Lys Ile Gln Gly Asp Gly Ala Ala Leu Gln Glu
Lys Leu Cys Ala Thr SEQ ID NO:482

13193.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Glu Pro Ser Gly Pro Ile Ser Thr Ile Asn Pro Ser Pro Pro

TABLE 3-continued

PROTEIN SEQUENCES

Ser Lys Glu Ser His Lys Ser Pro Asn Met Ala Tyr Lys Leu Cys
His Pro Glu Glu Leu Val Leu Leu Gly His Ser Leu Gly Ile Pro
Trp Ala Pro Leu Ser Ser Cys Pro Ser Gln Ala Leu Gln Leu Ala
Gly Cys Leu Ser Gln Leu His Ser Gly Leu Phe Leu Tyr Gln Gly
Leu Leu Gln Ala Leu Glu Gly Ile Ser Pro Glu Leu Gly Pro Thr
Leu Asp Thr Leu Gln Leu Asp Val Ala Asp Phe Ala Thr Thr Ile
Trp Gln Gln Met Glu Glu Leu Gly Met Ala Pro Ala Leu Gln Pro
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Thr Pro Leu
Gly Pro Ala Ser Ser Leu Pro Gln Ser Phe Leu Leu Lys Ser Leu
Glu Gln Val Arg Lys Ile Gln Gly Asp Gly Ala Ala Leu Gln Glu
Lys Leu Cys Ala Thr SEQ ID NO:483

25190.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Pro Glu Leu Gly
Pro Thr Leu Asp Thr Leu Gln Leu Asp Val Ala Asp Phe Ala Thr
Thr Ile Trp Gln Gln Met Glu Glu Leu Gly Met Ala Pro Ala Leu
Gln Pro Thr Gln Gly Ala Met Pro Ala Phe Ala Ser Ala Phe Gln
Arg Arg Ala Gly Gly Val Leu Val Ala Ser His Leu Gln Ser Phe
Leu Glu Val Ser Tyr Arg Val Leu Arg His Leu Ala Gln Pro Thr
Pro Leu Gly Pro Ala Ser Ser Leu Pro Gln Ser Phe Leu Leu Lys
Ser Leu Glu Gln Val Arg Lys Ile Gln Gly Asp Gly Ala Ala Leu
Gln Glu Lys Leu Cys Ala Thr Tyr Lys Leu Cys His Pro Glu Glu
Leu Val Leu Leu Gly His Ser Leu Gly Ile Pro Trp Ala Pro Leu
Ser Ser Cys Pro Ser Gln Ala Leu Gln Leu Ala Gly Cys Leu Ser
Gln Leu His Ser Gly Leu Phe Leu Tyr Gln Gly Leu Leu Gln Ala
Leu Glu Gly Ile Ser SEQ ID NO:484 pMON25191.Pep

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Pro Glu Leu Gly
Pro Thr Leu Asp Thr Leu Gln Leu Asp Val Ala Asp Phe Ala Thr
Thr Ile Trp Gln Gln Met Glu Glu Leu Gly Met Ala Pro Ala Leu
Gln Pro Thr Gln Gly Ala Met Pro Ala Phe Ala Ser Ala Phe Gln
Arg Arg Ala Gly Gly Val Leu Val Ala Ser His Leu Gln Ser Phe
Leu Glu Val Ser Tyr Arg Val Leu Arg His Leu Ala Gln Pro Thr
Pro Leu Gly Pro Ala Ser Ser Leu Pro Gln Ser Phe Leu Leu Lys
Ser Leu Glu Gln Val Arg Lys Ile Gln Gly Asp Gly Ala Ala Leu
Gln Glu Lys Leu Cys Ala Thr Tyr Lys Leu Cys His Pro Glu Glu
Leu Val Leu Leu Gly His Ser Leu Gly Ile Pro Trp Ala Pro Leu
Ser Ser Cys Pro Ser Gln Ala Leu Gln Leu Ala Gly Cys Leu Ser
Gln Leu His Ser Gly Leu Phe Leu Tyr Gln Gly Leu Leu Gln Ala
Leu Glu Gly Ile Ser SEQ ID NO:485

13194.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Met Ala Pro Ala
Leu Gln Pro Thr Gln Gly Ala Met Pro Ala Phe Ala Ser Ala Phe
Gln Arg Arg Ala Gly Gly Val Leu Val Ala Ser His Leu Gln Ser
Phe Leu Glu Val Ser Tyr Arg Val Leu Arg His Leu Ala Gln Pro

TABLE 3-continued

PROTEIN SEQUENCES

```
Thr Pro Leu Gly Pro Ala Ser Ser Leu Pro Gln Ser Phe Leu Leu
Lys Ser Leu Glu Gln Val Arg Lys Ile Gln Gly Asp Gly Ala Ala
Leu Gln Glu Lys Leu Cys Ala Thr Tyr Lys Leu Cys His Pro Glu
Glu Leu Val Leu Gly His Ser Leu Gly Ile Pro Trp Ala Pro
Leu Ser Ser Cys Pro Ser Gln Ala Leu Gln Leu Ala Gly Cys Leu
Ser Gln Leu His Ser Gly Leu Phe Leu Tyr Gln Gly Leu Leu Gln
Ala Leu Glu Gly Ile Ser Pro Glu Leu Gly Pro Thr Leu Asp Thr
Leu Gln Leu Asp Val Ala Asp Phe Ala Thr Thr Ile Trp Gln Gln
Met Glu Glu Leu Gly      SEQ ID NO:486
```

13195.Pept

```
Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Met Ala Pro Ala
Leu Gln Pro Thr Gln Gly Ala Met Pro Ala Phe Ala Ser Ala Phe
Gln Arg Arg Ala Gly Gly Val Leu Val Ala Ser His Leu Gln Ser
Phe Leu Glu Val Ser Tyr Arg Val Leu Arg His Leu Ala Gln Pro
Thr Pro Leu Gly Pro Ala Ser Ser Leu Pro Gln Ser Phe Leu Leu
Lys Ser Leu Glu Gln Val Arg Lys Ile Gln Gly Asp Gly Ala Ala
Leu Gln Glu Lys Leu Cys Ala Thr Tyr Lys Leu Cys His Pro Glu
Glu Leu Val Leu Gly His Ser Leu Gly Ile Pro Trp Ala Pro
Leu Ser Ser Cys Pro Ser Gln Ala Leu Gln Leu Ala Gly Cys Leu
Ser Gln Leu His Ser Gly Leu Phe Leu Tyr Gln Gly Leu Leu Gln
Ala Leu Glu Gly Ile Ser Pro Glu Leu Gly Pro Thr Leu Asp Thr
Leu Gln Leu Asp Val Ala Asp Phe Ala Thr Thr Ile Trp Gln Gln
Met Glu Glu Leu Gly      SEQ ID NO:487
```

13196.Pept

```
Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Thr Gln Gly Ala
Met Pro Ala Phe Ala Ser Ala Phe Gln Arg Arg Ala Gly Gly Val
Leu Val Ala Ser His Leu Gln Ser Phe Leu Glu Val Ser Tyr Arg
Val Leu Arg His Leu Ala Gln Pro Thr Pro Leu Gly Pro Ala Ser
Ser Leu Pro Gln Ser Phe Leu Leu Lys Ser Leu Glu Gln Val Arg
Lys Ile Gln Gly Asp Gly Ala Ala Leu Gln Glu Lys Leu Cys Ala
Thr Tyr Lys Leu Cys His Pro Glu Glu Leu Val Leu Leu Gly His
Ser Leu Gly Ile Pro Trp Ala Pro Leu Ser Ser Cys Pro Ser Gln
Ala Leu Gln Leu Ala Gly Cys Leu Ser Gln Leu His Ser Gly Leu
Phe Leu Tyr Gln Gly Leu Leu Gln Ala Leu Glu Gly Ile Ser Pro
Glu Leu Gly Pro Thr Leu Asp Thr Leu Gln Leu Asp Val Ala Asp
Phe Ala Thr Thr Ile Trp Gln Gln Met Glu Glu Leu Gly Met Ala
Pro Ala Leu Gln Pro      SEQ ID NO:488
```

13197.Pept

```
Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Thr Gln Gly Ala
Met Pro Ala Phe Ala Ser Ala Phe Gln Arg Arg Ala Gly Gly Val
Leu Val Ala Ser His Leu Gln Ser Phe Leu Glu Val Ser Tyr Arg
Val Leu Arg His Leu Ala Gln Pro Thr Pro Leu Gly Pro Ala Ser
Ser Leu Pro Gln Ser Phe Leu Leu Lys Ser Leu Glu Gln Val Arg
Lys Ile Gln Gly Asp Gly Ala Ala Leu Gln Glu Lys Leu Cys Ala
Thr Tyr Lys Leu Cys His Pro Glu Glu Leu Val Leu Leu Gly His
```

TABLE 3-continued

PROTEIN SEQUENCES

Ser Leu Gly Ile Pro Trp Ala Pro Leu Ser Ser Cys Pro Ser Gln
Ala Leu Gln Leu Ala Gly Cys Leu Ser Gln Leu His Ser Gly Leu
Phe Leu Tyr Gln Gly Leu Leu Gln Ala Leu Glu Gly Ile Ser Pro
Glu Leu Gly Pro Thr Leu Asp Thr Leu Gln Leu Asp Val Ala Asp
Phe Ala Thr Thr Ile Trp Gln Gln Met Glu Glu Leu Gly Met Ala
Pro Ala Leu Gln Pro SEQ ID NO:489

13198.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Ser Ala Phe Gln
Arg Arg Ala Gly Gly Val Leu Val Ala Ser His Leu Gln Ser Phe
Leu Glu Val Ser Tyr Arg Val Leu Arg His Leu Ala Gln Pro Thr
Pro Leu Gly Pro Ala Ser Ser Leu Pro Gln Ser Phe Leu Leu Lys
Ser Leu Glu Gln Val Arg Lys Ile Gln Gly Asp Gly Ala Ala Leu
Gln Glu Lys Leu Cys Ala Thr Tyr Lys Leu Cys His Pro Glu Glu
Leu Val Leu Leu Gly His Ser Leu Gly Ile Pro Trp Ala Pro Leu
Ser Ser Cys Pro Ser Gln Ala Leu Gln Leu Ala Gly Cys Leu Ser
Gln Leu His Ser Gly Leu Phe Leu Tyr Gln Gly Leu Leu Gln Ala
Leu Glu Gly Ile Ser Pro Glu Leu Gly Pro Thr Leu Asp Thr Leu
Gln Leu Asp Val Ala Asp Phe Ala Thr Thr Ile Trp Gln Gln Met
Glu Glu Leu Gly Met Ala Pro Ala Leu Gln Pro Thr Gln Gly Ala
Met Pro Ala Phe Ala SEQ ID NO:490

13199.Pept

Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Ser Ala Phe Gln
Arg Arg Ala Gly Gly Val Leu Val Ala Ser His Leu Gln Ser Phe
Leu Glu Val Ser Tyr Arg Val Leu Arg His Leu Ala Gln Pro Thr
Pro Leu Gly Pro Ala Ser Ser Leu Pro Gln Ser Phe Leu Leu Lys
Ser Leu Glu Gln Val Arg Lys Ile Gln Gly Asp Gly Ala Ala Leu
Gln Glu Lys Leu Cys Ala Thr Tyr Lys Leu Cys His Pro Glu Glu
Leu Val Leu Leu Gly His Ser Leu Gly Ile Pro Trp Ala Pro Leu
Ser Ser Cys Pro Ser Gln Ala Leu Gln Leu Ala Gly Cys Leu Ser
Gln Leu His Ser Gly Leu Phe Leu Tyr Gln Gly Leu Leu Gln Ala
Leu Glu Gly Ile Ser Pro Glu Leu Gly Pro Thr Leu Asp Thr Leu
Gln Leu Asp Val Ala Asp Phe Ala Thr Thr Ile Trp Gln Gln Met
Glu Glu Leu Gly Met Ala Pro Ala Leu Gln Pro Thr Gln Gly Ala
Met Pro Ala Phe Ala SEQ ID NO:491

31104.Pep

Leu Asp Pro Asn Asn Leu Asn Asp Glu Asp Val Ser Ile Leu Met
Asp Arg Asn Leu Arg Leu Pro Asn Leu Glu Ser Phe Val Arg Ala
Val Lys Asn Leu Glu Asn Ala Ser Gly Ile Glu Ala Ile Leu Arg
Asn Leu Gln Pro Cys Leu Pro Ser Ala Thr Ala Ala Pro Ser Arg
His Pro Ile Ile Ile Lys Ala Gly Asp Trp Gln Glu Phe Arg Glu
Lys Leu Thr Phe Tyr Leu Val Thr Leu Glu Gln Ala Gln Glu Gln
Gln Gly Gly Gly Ser Asn Cys Ser Ile Met Ile Asp Glu Ile Ile
His His Leu Lys Arg Pro Pro Ala Pro Leu Tyr Val Glu Gly Gly
Gly Gly Ser Pro Gly Glu Pro Ser Gly Pro Ile Ser Thr Ile Asn
Pro Ser Pro Pro Ser Lys Glu Ser His Lys Ser Pro Asn Met Ala
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Ser Gly Gly
Ser Gly Gly Ser Gln Ser Phe Leu Leu Lys Ser Leu Glu Gln Val
Arg Lys Ile Gln Gly Asp Gly Ala Ala Leu Gln Glu Lys Leu Cys
Ala Thr Tyr Lys Leu Cys His Pro Glu Glu Leu Val Leu Leu Gly
His Ser Leu Gly Ile Pro Trp Ala Pro Leu Ser Ser Cys Pro Ser
Gln Ala Leu Gln Leu Ala Gly Cys Leu Ser Gln Leu His Ser Gly
Leu Phe Leu Tyr Gln Gly Leu Leu Gln Ala Leu Glu Gly Ile Ser

TABLE 3-continued

PROTEIN SEQUENCES

Pro Glu Leu Gly Pro Thr Leu Asp Thr Leu Gln Leu Asp Val Ala
Asp Phe Ala Thr Thr Ile Trp Gln Gln Met Glu Glu Leu Gly Met
Ala Pro Ala Leu Gln Pro SEQ ID NO:492

31105.Pep

Asn Ala Ser Gly Ile Glu Ala Ile Leu Arg Asn Leu Gln Pro Cys
Leu Pro Ser Ala Thr Ala Ala Pro Ser Arg His Pro Ile Ile Ile
Lys Ala Gly Asp Trp Gln Glu Phe Arg Glu Lys Leu Thr Phe Tyr
Leu Val Thr Leu Glu Gln Ala Gln Glu Gln Gln Gly Gly Gly Ser
Asn Cys Ser Ile Met Ile Asp Glu Ile Ile His His Leu Lys Arg
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Tyr Val Glu Gly Gly
Gly Gly Ser Pro Gly Glu Pro Ser Gly Pro Ile Ser Thr Ile Asn
Pro Ser Pro Pro Ser Lys Glu Ser His Lys Ser Pro Asn Met Ala
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Ser Gly Gly
Ser Gly Gly Ser Gln Ser Phe Leu Leu Lys Ser Leu Glu Gln Val
Arg Lys Ile Gln Gly Asp Gly Ala Ala Leu Gln Glu Lys Leu Cys
Ala Thr Tyr Lys Leu Cys His Pro Glu Glu Leu Val Leu Leu Gly
His Ser Leu Gly Ile Pro Trp Ala Pro Leu Ser Ser Cys Pro Ser
Gln Ala Leu Gln Leu Ala Gly Cys Leu Ser Gln Leu His Ser Gly
Leu Phe Leu Tyr Gln Gly Leu Leu Gln Ala Leu Glu Gly Ile Ser
Pro Glu Leu Gly Pro Thr Leu Asp Thr Leu Gln Leu Asp Val Ala
Asp Phe Ala Thr Thr Ile Trp Gln Gln Met Glu Glu Leu Gly Met
Ala Pro Ala Leu Gln Pro SEQ ID NO:493

31106.Pep

Ala Pro Ser Arg His Pro Ile Ile Ile Lys Ala Gly Asp Trp Gln
Glu Phe Arg Glu Lys Leu Thr Phe Tyr Leu Val Thr Leu Glu Gln
Ala Gln Glu Gln Gln Gly Gly Gly Ser Asn Cys Ser Ile Met Ile
Asp Glu Ile Ile His His Leu Lys Arg Pro Pro Ala Pro Leu Leu
Asp Pro Asn Asn Leu Asn Asp Glu Asp Val Ser Ile Leu Met Asp
Arg Asn Leu Arg Leu Pro Asn Leu Glu Ser Phe Val Arg Ala Val
Lys Asn Leu Glu Asn Ala Ser Gly Ile Glu Ala Ile Leu Arg Asn
Leu Gln Pro Cys Leu Pro Ser Ala Thr Ala Tyr Val Glu Gly Gly
Gly Gly Ser Pro Gly Glu Pro Ser Gly Pro Ile Ser Thr Ile Asn
Pro Ser Pro Pro Ser Lys Glu Ser His Lys Ser Pro Asn Met Ala
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Ser Gly Gly
Ser Gly Gly Ser Gln Ser Phe Leu Leu Lys Ser Leu Glu Gln Val
Arg Lys Ile Gln Gly Asp Gly Ala Ala Leu Gln Glu Lys Leu Cys
Ala Thr Tyr Lys Leu Cys His Pro Glu Glu Leu Val Leu Leu Gly
His Ser Leu Gly Ile Pro Trp Ala Pro Leu Ser Ser Cys Pro Ser
Gln Ala Leu Gln Leu Ala Gly Cys Leu Ser Gln Leu His Ser Gly
Leu Phe Leu Tyr Gln Gly Leu Leu Gln Ala Leu Glu Gly Ile Ser
Pro Glu Leu Gly Pro Thr Leu Asp Thr Leu Gln Leu Asp Val Ala
Asp Phe Ala Thr Thr Ile Trp Gln Gln Met Glu Glu Leu Gly Met
Ala Pro Ala Leu Gln Pro SEQ ID NO:494

31107.Pep

Ala Gly Asp Trp Gln Glu Phe Arg Glu Lys Leu Thr Phe Tyr Leu
Val Thr Leu Glu Gln Ala Gln Glu Gln Gln Gly Gly Gly Ser Asn
Cys Ser Ile Met Ile Asp Glu Ile Ile His His Leu Lys Arg Pro
Pro Ala Pro Leu Leu Asp Pro Asn Asn Leu Asn Asp Glu Asp Val
Ser Ile Leu Met Asp Arg Asn Leu Arg Leu Pro Asn Leu Glu Ser
Phe Val Arg Ala Val Lys Asn Leu Glu Asn Ala Ser Gly Ile Glu
Ala Ile Leu Arg Asn Leu Gln Pro Cys Leu Pro Ser Ala Thr Ala
Ala Pro Ser Arg His Pro Ile Ile Ile Lys Tyr Val Glu Gly Gly
Gly Gly Ser Pro Gly Glu Pro Ser Gly Pro Ile Ser Thr Ile Asn
Pro Ser Pro Pro Ser Lys Glu Ser His Lys Ser Pro Asn Met Ala
Thr Gln Gly Ala Met Pro Ala Phe Ala Ser Ala Phe Gln Arg Arg
Ala Gly Gly Val Leu Val Ala Ser His Leu Gln Ser Phe Leu Glu
Val Ser Tyr Arg Val Leu Arg His Leu Ala Gln Pro Ser Gly Gly
Ser Gly Gly Ser Gln Ser Phe Leu Leu Lys Ser Leu Glu Gln Val
Arg Lys Ile Gln Gly Asp Gly Ala Ala Leu Gln Glu Lys Leu Cys
Ala Thr Tyr Lys Leu Cys His Pro Glu Glu Leu Val Leu Leu Gly
His Ser Leu Gly Ile Pro Trp Ala Pro Leu Ser Ser Cys Pro Ser
Gln Ala Leu Gln Leu Ala Gly Cys Leu Ser Gln Leu His Ser Gly
Leu Phe Leu Tyr Gln Gly Leu Leu Gln Ala Leu Glu Gly Ile Ser
Pro Glu Leu Gly Pro Thr Leu Asp Thr Leu Gln Leu Asp Val Ala

TABLE 3-continued

PROTEIN SEQUENCES

Asp Phe Ala Thr Thr Ile Trp Gln Gln Met Glu Glu Leu Gly Met
Ala Pro Ala Leu Gln Pro SEQ ID NO:495

31108.Pep

Leu Asp Pro Asn Asn Leu Asn Asp Glu Asp Val Ser Ile Leu Met
Asp Arg Asn Leu Arg Leu Pro Asn Leu Glu Ser Phe Val Arg Ala
Val Lys Asn Leu Glu Asn Ala Ser Gly Ile Glu Ala Ile Leu Arg
Asn Leu Gln Pro Cys Leu Pro Ser Ala Thr Ala Ala Pro Ser Arg
His Pro Ile Ile Lys Ala Gly Asp Trp Gln Glu Phe Arg Glu
Lys Leu Thr Phe Tyr Leu Val Thr Leu Glu Gln Ala Gln Glu Gln
Gln Gly Gly Gly Ser Gly Gly Gly Ser Gly Gly Gly Ser Asn Cys
Ser Ile Met Ile Asp Glu Ile Ile His His Leu Lys Arg Pro Pro
Ala Pro Leu Tyr Val Glu Gly Gly Gly Gly Ser Pro Gly Glu Pro
Ser Gly Pro Ile Ser Thr Ile Asn Pro Ser Pro Pro Ser Lys Glu
Ser His Lys Ser Pro Asn Met Ala Thr Gln Gly Ala Met Pro Ala
Phe Ala Ser Ala Phe Gln Arg Arg Ala Gly Gly Val Leu Val Ala
Ser His Leu Gln Ser Phe Leu Glu Val Ser Tyr Arg Val Leu Arg
His Leu Ala Gln Pro Ser Gly Gly Ser Gly Gly Ser Gln Ser Phe
Leu Leu Lys Ser Leu Glu Gln Val Arg Lys Ile Gln Gly Asp Gly
Ala Ala Leu Gln Glu Lys Leu Cys Ala Thr Tyr Lys Leu Cys His
Pro Glu Glu Leu Val Leu Leu Gly His Ser Leu Gly Ile Pro Trp
Ala Pro Leu Ser Ser Cys Pro Ser Gln Ala Leu Gln Leu Ala Gly
Cys Leu Ser Gln Leu His Ser Gly Leu Phe Leu Tyr Gln Gly Leu
Leu Gln Ala Leu Glu Gly Ile Ser Pro Glu Leu Gly Pro Thr Leu
Asp Thr Leu Gln Leu Asp Val Ala Asp Phe Ala Thr Thr Ile Trp
Gln Gln Met Glu Glu Leu Gly Met Ala Pro Ala Leu Gln Pro SEQ ID NO:496

31109.Pep

Asn Ala Ser Gly Ile Glu Ala Ile Leu Arg Asn Leu Gln Pro Cys
Leu Pro Ser Ala Thr Ala Ala Pro Ser Arg His Pro Ile Ile Ile
Lys Ala Gly Asp Trp Gln Glu Phe Arg Glu Lys Leu Thr Phe Tyr
Leu Val Thr Leu Glu Gln Ala Gln Glu Gln Gln Gly Gly Gly Ser
Gly Gly Gly Ser Gly Gly Gly Ser Asn Cys Ser Ile Met Ile Asp
Glu Ile Ile His His Leu Lys Arg Pro Pro Ala Pro Leu Leu Asp
Pro Asn Asn Leu Asn Asp Glu Asp Val Ser Ile Leu Met Asp Arg
Asn Leu Arg Leu Pro Asn Leu Glu Ser Phe Val Arg Ala Val Lys
Asn Leu Glu Tyr Val Glu Gly Gly Gly Gly Ser Pro Gly Glu Pro
Ser Gly Pro Ile Ser Thr Ile Asn Pro Ser Pro Pro Ser Lys Glu
Ser His Lys Ser Pro Asn Met Ala Thr Gln Gly Ala Met Pro Ala
Phe Ala Ser Ala Phe Gln Arg Arg Ala Gly Gly Val Leu Val Ala
Ser His Leu Gln Ser Phe Leu Glu Val Ser Tyr Arg Val Leu Arg
His Leu Ala Gln Pro Ser Gly Gly Ser Gly Gly Ser Gln Ser Phe
Leu Leu Lys Ser Leu Glu Gln Val Arg Lys Ile Gln Gly Asp Gly
Ala Ala Leu Gln Glu Lys Leu Cys Ala Thr Tyr Lys Leu Cys His
Pro Glu Glu Leu Val Leu Leu Gly His Ser Leu Gly Ile Pro Trp
Ala Pro Leu Ser Ser Cys Pro Ser Gln Ala Leu Gln Leu Ala Gly
Cys Leu Ser Gln Leu His Ser Gly Leu Phe Leu Tyr Gln Gly Leu
Leu Gln Ala Leu Glu Gly Ile Ser Pro Glu Leu Gly Pro Thr Leu
Asp Thr Leu Gln Leu Asp Val Ala Asp Phe Ala Thr Thr Ile Trp
Gln Gln Met Glu Glu Leu Gly Met Ala Pro Ala Leu Gln Pro
SEQ ID NO:497

31110.Pep

Ala Pro Ser Arg His Pro Ile Ile Ile Lys Ala Gly Asp Trp Gln
Glu Phe Arg Glu Lys Leu Thr Phe Tyr Leu Val Thr Leu Glu Gln
Ala Gln Glu Gln Gln Gly Gly Gly Ser Gly Gly Gly Ser Gly Gly
Gly Ser Asn Cys Ser Ile Met Ile Asp Glu Ile Ile His His Leu
Lys Arg Pro Pro Ala Pro Leu Leu Asp Pro Asn Asn Leu Asn Asp
Glu Asp Val Ser Ile Leu Met Asp Arg Asn Leu Arg Leu Pro Asn
Leu Glu Ser Phe Val Arg Ala Val Lys Asn Leu Glu Asn Ala Ser
Gly Ile Glu Ala Ile Leu Arg Asn Leu Gln Pro Cys Leu Pro Ser
Ala Thr Ala Tyr Val Glu Gly Gly Gly Gly Ser Pro Gly Glu Pro
Ser Gly Pro Ile Ser Thr Ile Asn Pro Ser Pro Pro Ser Lys Glu
Ser His Lys Ser Pro Asn Met Ala Thr Gln Gly Ala Met Pro Ala
Phe Ala Ser Ala Phe Gln Arg Arg Ala Gly Gly Val Leu Val Ala
Ser His Leu Gln Ser Phe Leu Glu Val Ser Tyr Arg Val Leu Arg
His Leu Ala Gln Pro Ser Gly Gly Ser Gly Gly Ser Gln Ser Phe
Leu Leu Lys Ser Leu Glu Gln Val Arg Lys Ile Gln Gly Asp Gly
Ala Ala Leu Gln Glu Lys Leu Cys Ala Thr Tyr Lys Leu Cys His
Pro Glu Glu Leu Val Leu Leu Gly His Ser Leu Gly Ile Pro Trp
Ala Pro Leu Ser Ser Cys Pro Ser Gln Ala Leu Gln Leu Ala Gly
Cys Leu Ser Gln Leu His Ser Gly Leu Phe Leu Tyr Gln Gly Leu
Leu Gln Ala Leu Glu Gly Ile Ser Pro Glu Leu Gly Pro Thr Leu

TABLE 3-continued

PROTEIN SEQUENCES

Asp Thr Leu Gln Leu Asp Val Ala Asp Phe Ala Thr Thr Ile Trp
Gln Gln Met Glu Glu Leu Gly Met Ala Pro Ala Leu Gln Pro
SEQ ID NO:498

31111.Pep

Ala Gly Asp Trp Gln Glu Phe Arg Glu Lys Leu Thr Phe Tyr Leu
Val Thr Leu Glu Gln Ala Gln Glu Gln Gln Gly Gly Gly Ser Gly
Gly Gly Ser Gly Gly Gly Ser Asn Cys Ser Ile Met Ile Asp Glu
Ile Ile His His Leu Lys Arg Pro Pro Ala Pro Leu Leu Asp Pro
Asn Asn Leu Asn Asp Glu Asp Val Ser Ile Leu Met Asp Arg Asn
Leu Arg Leu Pro Asn Leu Glu Ser Phe Val Arg Ala Val Lys Asn
Leu Glu Asn Ala Ser Gly Ile Glu Ala Ile Leu Arg Asn Leu Gln
Pro Cys Leu Pro Ser Ala Thr Ala Ala Pro Ser Arg His Pro Ile
Ile Ile Lys Tyr Val Glu Gly Gly Gly Ser Pro Gly Glu Pro
Ser Gly Pro Ile Ser Thr Ile Asn Pro Ser Pro Pro Ser Lys Glu
Ser His Lys Ser Pro Asn Met Ala Thr Gln Gly Ala Met Pro Ala
Phe Ala Ser Ala Phe Gln Arg Arg Ala Gly Gly Val Leu Val Ala
Ser His Leu Gln Ser Phe Leu Glu Val Ser Tyr Arg Val Leu Arg
His Leu Ala Gln Pro Ser Gly Gly Ser Gly Gly Ser Gln Ser Phe
Leu Leu Lys Ser Leu Glu Gln Val Arg Lys Ile Gln Gly Asp Gly
Ala Ala Leu Gln Glu Lys Leu Cys Ala Thr Tyr Lys Leu Cys His
Pro Glu Glu Leu Val Leu Leu Gly His Ser Leu Gly Ile Pro Trp
Ala Pro Leu Ser Ser Cys Pro Ser Gln Ala Leu Gln Leu Ala Gly
Cys Leu Ser Gln Leu His Ser Gly Leu Phe Leu Tyr Gln Gly Leu
Leu Gln Ala Leu Glu Gly Ile Ser Pro Glu Leu Gly Pro Thr Leu
Asp Thr Leu Gln Leu Asp Val Ala Asp Phe Ala Thr Thr Ile Trp
Gln Gln Met Glu Glu Leu Gly Met Ala Pro Ala Leu Gln Pro
SEQ ID NO:499 pMON15981

MetAlaAsnCysSerIleMetIleAspGluIleIleHisHisLeuLysArgProProAla
ProLeuLeuAspProAsnAsnLeuAsnAspGluAspValSerIleLeuMetAspArgAsn
LeuArgLeuProAsnLeuGluSerPheValArgAlaValLysAsnLeuGluAsnAlaSer
GlyIleGluAlaIleLeuArgAsnLeuGlnProCysLeuProSerAlaThrAlaAlaPro
SerArgHisProIleIleIleLysAlaGlyAspTrpGlnGluPheArgGluLysLeuThr
PheTyrLeuValThrLeuGluGlnAlaGlnGluGlnGlnTyrValGluGlyGlyGlyGly
SerProGlyGluProSerGlyProIleSerThrIleAsnProSerProProSerLysGlu
SerHisLysSerProAsnMetAlaTyrLysLeuCysHisProGluGluLeuValLeuLeu
GlyHisSerLeuGlyIleProTrpAlaProLeuSerSerCysProSerGlnAlaLeuGln
LeuAlaGlyCysLeuSerGlnLeuHisSerGlyLeuPheLeuTyrGlnGlyLeuLeuGln
AlaLeuGluGlyIleSerProGluLeuGlyProThrLeuAspThrLeuGlnLeuAspVal
AlaAspPheAlaThrThrIleTrpGlnGlnMetGluGluLeuGlyMetAlaProAlaLeu
GlnProThrGlnGlyAlaMetProAlaPheAlaSerAlaPheGlnArgArgAlaGlyGly
ValLeuValAlaSerHisLeuGlnSerPheLeuGluValSerTyrArgValLeuArgHis
LeuAlaGlnProGlyGlyGlySerAspMetAlaThrProLeuGlyProAlaSerSerLeu
ProGlnSerPheLeuLeuLysSerLeuGluGlnValArgLysIleGlnGlyAspGlyAla
AlaLeuGlnGluLysLeuCysAlaThr SEQ ID NO:500 pMON15982

MetAlaAsnCysSerIleMetIleAspGluIleIleHisHisLeuLysArgProProAla
ProLeuLeuAspProAsnAsnLeuAsnAspGluAspValSerIleLeuMetAspArgAsn
LeuArgLeuProAsnLeuGluSerPheValArgAlaValLysAsnLeuGluAsnAlaSer
GlyIleGluAlaIleLeuArgAsnLeuGlnProCysLeuProSerAlaThrAlaAlaPro
SerArgHisProIleIleIleLysAlaGlyAspTrpGlnGluPheArgGluLysLeuThr
PheTyrLeuValThrLeuGluGlnAlaGlnGluGlnGlnTyrValGluGlyGlyGlyGly
SerProGlyGluProSerGlyProIleSerThrIleAsnProSerProProSerLysGlu
SerHisLysSerProAsnMetAlaProGluLeuGlyProThrLeuAspThrLeuGlnLeu
AspValAlaAspPheAlaThrThrIleTrpGlnGlnMetGluGluLeuGlyMetAlaPro
AlaLeuGlnProThrGlnGlyAlaMetProAlaPheAlaSerAlaPheGlnArgArgAla
GlyGlyValLeuValAlaSerHisLeuGlnSerPheLeuGluValSerTyrArgValLeu
ArgHisLeuAlaGlnProGlyGlyGlySerAspMetAlaThrProLeuGlyProAlaSer
SerLeuProGlnSerPheLeuLeuLysSerLeuGluGlnValArgLysIleGlnGlyAsp
GlyAlaAlaLeuGlnGluLysLeuCysAlaThrTyrLysLeuCysHisProGluGluLeu
ValLeuLeuGlyHisSerLeuGlyIleProTrpAlaProLeuSerSerCysProSerGln
AlaLeuGlnLeuAlaGlyCysLeuSerGlnLeuHisSerGlyLeuPheLeuTyrGlnGly
LeuLeuGlnAlaLeuGluGlyIleSer SEQ ID NO:501 pMON15965

MetAlaAsnCysSerIleMetIleAspGluIleIleHisHisLeuLysArgProProAla
ProLeuLeuAspProAsnAsnLeuAsnAspGluAspValSerIleLeuMetAspArgAsn
LeuArgLeuProAsnLeuGluSerPheValArgAlaValLysAsnLeuGluAsnAlaSer
GlyIleGluAlaIleLeuArgAsnLeuGlnProCysLeuProSerAlaThrAlaAlaPro
SerArgHisProIleIleIleLysAlaGlyAspTrpGlnGluPheArgGluLysLeuThr

TABLE 3-continued

PROTEIN SEQUENCES

PheTyrLeuValThrLeuGluGlnAlaGlnGluGlnGlnTyrValGluGlyGlyGlyGly
SerProGlyGluProSerGlyProIleSerThrIleAsnProSerProProSerLysGlu
SerHisLysSerProAsnMetAlaSerAlaPheGlnArgArgAlaGlyGlyValLeuVal
AlaSerHisLeuGlnSerPheLeuGluValSerTyrArgValLeuArgHisLeuAlaGln
ProGlyGlyGlySerAspMetAlaThrProLeuGlyProAlaSerSerLeuProGlnSer
PheLeuLeuLysSerLeuGlnValArgLysIleGlnGlyAspGlyAlaAlaLeuGln
GluLysLeuCysAlaThrTyrLysLeuCysHisProGluGluLeuValLeuLeuGlyHis
SerLeuGlyIleProTrpAlaProLeuSerSerCysProSerGlnAlaLeuGlnLeuAla
GlyCysLeuSerGlnLeuHisSerGlyLeuPheLeuTyrGlnGlyLeuLeuGlnAlaLeu
GluGlyIleSerProGluLeuGlyProThrLeuAspThrLeuGlnLeuAspValAlaAsp
PheAlaThrThrIleTrpGlnGlnMetGluGluLeuGlyMetAlaProAlaLeuGlnPro
ThrGlnGlyAlaMetProAlaPheAla SEQ ID NO:502 pMON15966

MetAlaAsnCysSerIleMetIleAspGluIleIleHisHisLeuLysArgProProAla
ProLeuLeuAspProAsnAsnLeuAsnAspGluAspValSerIleLeuMetAspArgAsn
LeuArgLeuProAsnLeuGluSerPheValArgAlaValLysAsnLeuGluAsnAlaSer
GlyIleGluAlaIleLeuArgAsnLeuGlnProCysLeuProSerAlaThrAlaAlaPro
SerArgHisProIleIleIleLysAlaGlyAspTrpGlnGluPheArgGluLysLeuThr
PheTyrLeuValThrLeuGluGlnAlaGlnGluGlnGlnTyrValGluGlyGlyGlyGly
SerProGlyGluProSerGlyProIleSerThrIleAsnProSerProProSerLysGlu
SerHisLysSerProAsnMetAlaMetAlaProAlaLeuGlnProThrGlnGlyAlaMet
ProAlaPheAlaSerAlaPheGlnArgArgAlaGlyGlyValLeuValAlaSerHisLeu
GlnSerPheLeuGluValSerTyrArgValLeuArgHisLeuAlaGlnProGlyGlyGly
SerAspMetAlaThrProLeuGlyProAlaSerSerLeuProGlnSerPheLeuLeuLys
SerLeuGluGlnValArgLysIleGlnGlyAspGlyAlaAlaLeuGlnGluLysLeuCys
AlaThrTyrLysLeuCysHisProGluGluLeuValLeuLeuGlyHisSerLeuGlyIle
ProTrpAlaProLeuSerSerCysProSerGlnAlaLeuGlnLeuAlaGlyCysLeuSer
GlnLeuHisSerGlyLeuPheLeuTyrGlnGlyLeuLeuGlnAlaLeuGluGlyIleSer
ProGluLeuGlyProThrLeuAspThrLeuGlnLeuAspValAlaAspPheAlaThrThr
IleTrpGlnGlnMetGluGluLeuGly SEQ ID NO:503 pMON15967

MetAlaAsnCysSerIleMetIleAspGluIleIleHisHisLeuLysArgProProAla
ProLeuLeuAspProAsnAsnLeuAsnAspGluAspValSerIleLeuMetAspArgAsn
LeuArgLeuProAsnLeuGluSerPheValArgAlaValLysAsnLeuGluAsnAlaSer
GlyIleGluAlaIleLeuArgAsnLeuGlnProCysLeuProSerAlaThrAlaAlaPro
SerArgHisProIleIleIleLysAlaGlyAspTrpGlnGluPheArgGluLysLeuThr
PheTyrLeuValThrLeuGluGlnAlaGlnGluGlnGlnTyrValGluGlyGlyGlyGly
SerProGlyGluProSerGlyProIleSerThrIleAsnProSerProProSerLysGlu
SerHisLysSerProAsnMetAlaThrGlnGlyAlaMetProAlaPheAlaSerAlaPhe
GlnArgArgAlaGlyGlyValLeuValAlaSerHisLeuGlnSerPheLeuGluValSer
TyrArgValLeuArgHisLeuAlaGlnProGlyGlyGlySerAspMetAlaThrProLeu
GlyProAlaSerSerLeuProGlnSerPheLeuLeuLysSerLeuGluGlnValArgLys
IleGlnGlyAspGlyAlaAlaLeuGlnGluLysLeuCysAlaThrTyrLysLeuCysHis
ProGluGluLeuValLeuLeuGlyHisSerLeuGlyIleProTrpAlaProLeuSerSer
CysProSerGlnAlaLeuGlnLeuAlaGlyCysLeuSerGlnLeuHisSerGlyLeuPhe
LeuTyrGlnGlyLeuLeuGlnAlaLeuGluGlyIleSerProGluLeuGlyProThrLeu
AspThrLeuGlnLeuAspValAlaAspPheAlaThrThrIleTrpGlnGlnMetGluGlu
LeuGlyMetAlaProAlaLeuGlnPro SEQ ID NO:504 pMON31112.pep

MetAlaAsnCysSerAsnMetIleAspGluIleIleThrHisLeuLysGlnProProLeu
ProLeuLeuAspPheAsnAsnLeuAsnGlyGluAspGlnAspIleLeuMetAspAsnAsn
LeuArgArgProAsnLeuGluAlaPheAsnArgAlaValLysSerLeuGlnAsnAlaSer
AlaIleGluSerIleLeuLysAsnLeuLeuProCysLeuProLeuAlaThrAlaAlaPro
ThrArgHisProIleHisIleLysAspGlyAspTrpAsnGluPheArgGlyLysLeuThr
PheTyrLeuLysThrLeuGluAsnAlaGlnAlaGlnGlnTyrValGluGlyGlyGlyGly
SerProGlyGluProSerGlyProIleSerThrIleAsnProSerProProSerLysGlu
SerHisLysSerProAsnMetAlaThrGlnGlyAlaMetProAlaPheAlaSerAlaPhe
GlnArgArgAlaGlyGlyValLeuValAlaSerHisLeuGlnSerPheLeuGluValSer
TyrArgValLeuArgHisLeuAlaGlnProSerGlyGlySerGlyGlySerGlnSerPhe
LeuLeuLysSerLeuGluGlnValArgLysIleGlnGlyAspGlyAlaAlaLeuGlnGlu
LysLeuCysAlaThrTyrLysLeuCysHisProGluGluLeuValLeuLeuGlyHisSer
LeuGlyIleProTrpAlaProLeuSerSerCysProSerGlnAlaLeuGlnLeuAlaGly
CysLeuSerGlnLeuHisSerGlyLeuPheLeuTyrGlnGlyLeuLeuGlnAlaLeuGlu
GlyIleSerProGluLeuGlyProThrLeuAspThrLeuGlnLeuAspValAlaAspPhe
AlaThrThrIleTrpGlnGlnMetGluGluLeuGlyMetAlaProAlaLeuGlnPro
SEQ ID NO:505 pMON31113.pep

MetAlaAsnCysSerAsnMetIleAspGluIleIleThrHisLeuLysGlnProProLeu
ProLeuLeuAspPheAsnAsnLeuAsnGlyGluAspGlnAspIleLeuMetGluAsnAsn

TABLE 3-continued

PROTEIN SEQUENCES

LeuArgArgProAsnLeuGluAlaPheAsnArgAlaValLysSerLeuGlnAsnAlaSer
AlaIleGluSerIleLeuLysAsnLeuLeuProCysLeuProLeuAlaThrAlaAlaPro
ThrArgHisProIleIleIleArgAspGlyAspTrpAsnGluPheArgArgLysLeuThr
PheTyrLeuLysThrLeuGluAsnAlaGlnAlaGlnGlnTyrValGluGlyGlyGlyGly
SerProGlyGluProSerGlyProIleSerThrIleAsnProSerProProSerLysGlu
SerHisLysSerProAsnMetAlaThrGlnGlyAlaMetProAlaPheAlaSerAlaPhe
GlnArgArgAlaGlyGlyValLeuValAlaSerHisLeuGlnSerPheLeuGluValSer
TyrArgValLeuArgHisLeuAlaGlnProThrProLeuGlyProAlaSerSerLeuPro
GlnSerPheLeuLeuLysSerLeuGluGlnValArgLysIleGlnGlyAspGlyAlaAla
LeuGlnGluLysLeuCysAlaThrTyrLysLeuCysHisProGluGluLeuValLeuLeu
GlyHisSerLeuGlyIleProTrpAlaProLeuSerSerCysProSerGlnAlaLeuGln
LeuAlaGlyCysLeuSerGlnLeuHisSerGlyLeuPheLeuTyrGlnGlyLeuLeuGln
AlaLeuGluGlyIleSerProGluLeuGlyProThrLeuAspThrLeuGlnLeuAspVal
AlaAspPheAlaThrThrIleTrpGlnGlnMetGluGluLeuGlyMetAlaProAlaLeu
GlnPro SEQ ID NO:506 pMON31114.pep

MetAlaAsnCysSerAsnMetIleAspGluIleIleThrHisLeuLysGlnProProLeu
ProLeuLeuAspPheAsnAsnLeuAsnGlyGluAspGlnAspIleLeuMetGluAsnAsn
LeuArgArgProAsnLeuGluAlaPheAsnArgAlaValLysSerLeuGlnAsnAlaSer
AlaIleGluSerIleLeuLysAsnLeuLeuProCysLeuProLeuAlaThrAlaAlaPro
ThrArgHisProIleIleIleArgAspGlyAspTrpAsnGluPheArgArgLysLeuThr
PheTyrLeuLysThrLeuGluAsnAlaGlnAlaGlnGlnTyrValGluGlyGlyGlyGly
SerProGlyGluProSerGlyProIleSerThrIleAsnProSerProProSerLysGlu
SerHisLysSerProAsnMetAlaThrGlnGlyAlaMetProAlaPheAlaSerAlaPhe
GlnArgArgAlaGlyGlyValLeuValAlaSerHisLeuGlnSerPheLeuGluValSer
TyrArgValLeuArgHisLeuAlaGlnProSerGlyGlySerGlyGlySerGlnSerPhe
LeuLeuLysSerLeuGluGlnValArgLysIleGlnGlyAspGlyAlaAlaLeuGlnGlu
LysLeuCysAlaThrTyrLysLeuCysHisProGluGluLeuValLeuLeuGlyHisSer
LeuGlyIleProTrpAlaProLeuSerSerCysProSerGlnAlaLeuGlnLeuAlaGly
CysLeuSerGlnLeuHisSerGlyLeuPheLeuTyrGlnGlyLeuLeuGlnAlaLeuGlu
GlyIleSerProGluLeuGlyProThrLeuAspThrLeuGlnLeuAspValAlaAspPhe
AlaThrThrIleTrpGlnGlnMetGluGluLeuGlyMetAlaProAlaLeuGlnPro
SEQ ID NO:507 pMON31115.pep

MetAlaAsnCysSerAsnMetIleAspGluIleIleThrHisLeuLysGlnProProLeu
ProLeuLeuAspPheAsnAsnLeuAsnGlyGluAspGlnAspIleLeuMetAspAsnAsn
LeuArgArgProAsnLeuGluAlaPheAsnArgAlaValLysSerLeuGlnAsnAlaSer
AlaIleGluSerIleLeuLysAsnLeuLeuProCysLeuProLeuAlaThrAlaAlaPro
ThrArgHisProIleHisIleLysAspGlyAspTrpAsnGluPheArgArgLysLeuThr
PheTyrLeuLysThrLeuGluAsnAlaGlnAlaGlnGlnTyrValGluGlyGlyGlyGly
SerProGlyGluProSerGlyProIleSerThrIleAsnProSerProProSerLysGlu
SerHisLysSerProAsnMetAlaThrGlnGlyAlaMetProAlaPheAlaSerAlaPhe
GlnArgArgAlaGlyGlyValLeuValAlaSerHisLeuGlnSerPheLeuGluValSer
TyrArgValLeuArgHisLeuAlaGlnProThrProLeuGlyProAlaSerSerLeuPro
GlnSerPheLeuLeuLysSerLeuGluGlnValArgLysIleGlnGlyAspGlyAlaAla
LeuGlnGluLysLeuCysAlaThrTyrLysLeuCysHisProGluGluLeuValLeuLeu
GlyHisSerLeuGlyIleProTrpAlaProLeuSerSerCysProSerGlnAlaLeuGln
LeuAlaGlyCysLeuSerGlnLeuHisSerGlyLeuPheLeuTyrGlnGlyLeuLeuGln
AlaLeuGluGlyIleSerProGluLeuGlyProThrLeuAspThrLeuGlnLeuAspVal
AlaAspPheAlaThrThrIleTrpGlnGlnMetGluGluLeuGlyMetAlaProAlaLeu
GlnPro SEQ ID NO:508 pMON28505

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGlnLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGluValHisProLeuProThrProValLeuLeuProAlaVal
AspPheSerLeuGlyGluTrpLysThrGlnMetGluGluThrLysAlaGlnAspIleLeu
GlyAlaValThrLeuLeuLeuGluGlyValMetAlaAlaArgGlyGlnLeuGlyProThr
CysLeuSerSerLeuLeuGlyGlnLeuSerGlyGlnValArgLeuLeuLeuGlyAlaLeu
GlnSerLeuLeuGlyThrGlnLeuProProGlnGlyArgThrThrAlaHisLysAspPro
AsnAlaIlePheLeuSerPheGlnHisLeuLeuArgGlyLysValArgPheLeuMetLeu
ValGlyGlySerThrLeuCysValArgGluPheGlyGlyAsnMetAlaSerProAlaPro
ProAlaCysAspLeuArgValLeuSerLysLeuLeuArgAspSerHisValLeuHisSer
ArgLeuSerGlnCysPro SEQ ID NO:509

TABLE 3-continued

PROTEIN SEQUENCES pMON28506

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetLeuProThrProValLeuLeuProAlaValAspPheSerLeu
GlyGluTrpLysThrGlnMetGluGluThrLysAlaGlnAspIleLeuGlyAlaValThr
LeuLeuLeuGluGlyValMetAlaAlaArgGlyGlnLeuGlyProThrCysLeuSerSer
LeuLeuGlyGlnLeuSerGlyGlnValArgLeuLeuLeuGlyAlaLeuGlnSerLeuLeu
GlyThrGlnLeuProProGlnGlyArgThrThrAlaHisLysAspProAsnAlaIlePhe
LeuSerPheGlnHisLeuLeuArgGlyLysValArgPheLeuMetLeuValGlyGlySer
ThrLeuCysValArgGluPheGlyGlyAsnMetAlaSerProAlaProProAlaCysAsp
LeuArgValLeuSerLysLeuLeuArgAspSerHisValLeuHisSerArgLeuSerGln
CysProGluValHisPro SEQ ID NO:510 pMON28507

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetValLeuLeuProAlaValAspPheSerLeuGlyGluTrpLys
ThrGlnMetGluGluThrLysAlaGlnAspIleLeuGlyAlaValThrLeuLeuLeuGlu
GlyValMetAlaAlaArgGlyGlnLeuGlyProThrCysLeuSerSerLeuLeuGlyGln
LeuSerGlyGlnValArgLeuLeuLeuGlyAlaLeuGlnSerLeuLeuGlyThrGlnLeu
ProProGlnGlyArgThrThrAlaHisLysAspProAsnAlaIlePheLeuSerPheGln
HisLeuLeuArgGlyLysValArgPheLeuMetLeuValGlyGlySerThrLeuCysVal
ArgGluPheGlyGlyAsnMetAlaSerProAlaProProAlaCysAspLeuArgValLeu
SerLysLeuLeuArgAspSerHisValLeuHisSerArgLeuSerGlnCysProGluVal
HisProLeuProThrPro SEQ ID NO:511 pMON28508

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaValAspPheSerLeuGlyGluTrpLysThrGlnMetGlu
GluThrLysAlaGlnAspIleLeuGlyAlaValThrLeuLeuLeuGluGlyValMetAla
AlaArgGlyGlnLeuGlyProThrCysLeuSerSerLeuLeuGlyGlnLeuSerGlyGln
ValArgLeuLeuLeuGlyAlaLeuGlnSerLeuLeuGlyThrGlnLeuProProGlnGly
ArgThrThrAlaHisLysAspProAsnAlaIlePheLeuSerPheGlnHisLeuLeuArg
GlyLysValArgPheLeuMetLeuValGlyGlySerThrLeuCysValArgGluPheGly
GlyAsnMetAlaSerProAlaProProAlaCysAspLeuArgValLeuSerLysLeuLeu
ArgAspSerHisValLeuHisSerArgLeuSerGlnCysProGluValHisProLeuPro
ThrProValLeuLeuPro SEQ ID NO:512 pMON28509

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAspPheSerLeuGlyGluTrpLysThrGlnMetGluGluThr
LysAlaGlnAspIleLeuGlyAlaValThrLeuLeuLeuGluGlyValMetAlaAlaArg
GlyGlnLeuGlyProThrCysLeuSerSerLeuLeuGlyGlnLeuSerGlyGlnValArg
LeuLeuLeuGlyAlaLeuGlnSerLeuLeuGlyThrGlnLeuProProGlnGlyArgThr
ThrAlaHisLysAspProAsnAlaIlePheLeuSerPheGlnHisLeuLeuArgGlyLys
ValArgPheLeuMetLeuValGlyGlySerThrLeuCysValArgGluPheGlyGlyAsn
MetAlaSerProAlaProProAlaCysAspLeuArgValLeuSerLysLeuLeuArgAsp
SerHisValLeuHisSerArgLeuSerGlnCysProGluValHisProLeuProThrPro
ValLeuLeuProAlaVal SEQ ID NO:513

TABLE 3-continued

PROTEIN SEQUENCES pMON28510

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGlyGluTrpLysThrGlnMetGluGluThrLysAlaGlnAsp
IleLeuGlyAlaValThrLeuLeuLeuGluGlyValMetAlaAlaArgGlyGlnLeuGly
ProThrCysLeuSerSerLeuLeuGlyGlnLeuSerGlyGlnValArgLeuLeuLeuGly
AlaLeuGlnSerLeuLeuGlyThrGlnLeuProProGlnGlyArgThrThrAlaHisLys
AspProAsnAlaIlePheLeuSerPheGlnHisLeuLeuArgGlyLysValArgPheLeu
MetLeuValGlyGlySerThrLeuCysValArgGluPheGlyGlyAsnMetAlaSerPro
AlaProProAlaCysAspLeuArgValLeuSerLysLeuLeuArgAspSerHisValLeu
HisSerArgLeuSerGlnCysProGluValHisProLeuProThrProValLeuLeuPro
AlaValAspPheSerLeu SEQ ID NO:514 pMON28511

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGlyProThrCysLeuSerSerLeuLeuGlyGlnLeuSerGly
GlnValArgLeuLeuLeuGlyAlaLeuGlnSerLeuLeuGlyThrGlnLeuProProGln
GlyArgThrThrAlaHisLysAspProAsnAlaIlePheLeuSerPheGlnHisLeuLeu
ArgGlyLysValArgPheLeuMetLeuValGlyGlySerThrLeuCysValArgGluPhe
GlyGlyAsnMetAlaSerProAlaProProAlaCysAspLeuArgValLeuSerLysLeu
LeuArgAspSerHisValLeuHisSerArgLeuSerGlnCysProGluValHisProLeu
ProThrProValLeuLeuProAlaValAspPheSerLeuGlyGluTrpLysThrGlnMet
GluGluThrLysAlaGlnAspIleLeuGlyAlaValThrLeuLeuLeuGluGlyValMet
AlaAlaArgGlyGlnLeu SEQ ID NO:515 pMON28512

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGlyThrGlnLeuProProGlnGlyArgThrThrAlaHisLys
AspProAsnAlaIlePheLeuSerPheGlnHisLeuLeuArgGlyLysValArgPheLeu
MetLeuValGlyGlySerThrLeuCysValArgGluPheGlyGlyAsnMetAlaSerPro
AlaProProAlaCysAspLeuArgValLeuSerLysLeuLeuArgAspSerHisValLeu
HisSerArgLeuSerGlnCysProGluValHisProLeuProThrProValLeuLeuPro
AlaValAspPheSerLeuGlyGluTrpLysThrGlnMetGluGluThrLysAlaGlnAsp
IleLeuGlyAlaValThrLeuLeuLeuGluGlyValMetAlaAlaArgGlyGlnLeuGly
ProThrCysLeuSerSerLeuLeuGlyGlnLeuSerGlyGlnValArgLeuLeuLeuGly
AlaLeuGlnSerLeuLeu SEQ ID NO:516 pMON28513

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGlyArgThrThrAlaHisLysAspProAsnAlaIlePheLeu
SerPheGlnHisLeuLeuArgGlyLysValArgPheLeuMetLeuValGlyGlySerThr
LeuCysValArgGluPheGlyGlyAsnMetAlaSerProAlaProProAlaCysAspLeu
ArgValLeuSerLysLeuLeuArgAspSerHisValLeuHisSerArgLeuSerGlnCys
ProGluValHisProLeuProThrProValLeuLeuProAlaValAspPheSerLeuGly
GluTrpLysThrGlnMetGluGluThrLysAlaGlnAspIleLeuGlyAlaValThrLeu
LeuLeuGluGlyValMetAlaAlaArgGlyGlnLeuGlyProThrCysLeuSerSerLeu
LeuGlyGlnLeuSerGlyGlnValArgLeuLeuLeuGlyAlaLeuGlnSerLeuLeuGly
ThrGlnLeuProProGln SEQ ID NO:517

TABLE 3-continued

PROTEIN SEQUENCES pMON28514

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaHisLysAspProAsnAlaIlePheLeuSerPheGlnHis
LeuLeuArgGlyLysValArgPheLeuMetLeuValGlyGlySerThrLeuCysValArg
GluPheGlyGlyAsnMetAlaSerProAlaProProAlaCysAspLeuArgValLeuSer
LysLeuLeuArgAspSerHisValLeuHisSerArgLeuSerGlnCysProGluValHis
ProLeuProThrProValLeuLeuProAlaValAspPheSerLeuGlyGluTrpLysThr
GlnMetGluGluThrLysAlaGlnAspIleLeuGlyAlaValThrLeuLeuLeuGluGly
ValMetAlaAlaArgGlyGlnLeuGlyProThrCysLeuSerSerLeuLeuGlyGlnLeu
SerGlyGlnValArgLeuLeuLeuGlyAlaLeuGlnSerLeuLeuGlyThrGlnLeuPro
ProGlnGlyArgThrThr SEQ ID NO:518 pMON28515

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAspProAsnAlaIlePheLeuSerPheGlnHisLeuLeuArg
GlyLysValArgPheLeuMetLeuValGlyGlySerThrLeuCysValArgGluPheGly
GlyAsnMetAlaSerProAlaProProAlaCysAspLeuArgValLeuSerLysLeuLeu
ArgAspSerHisValLeuHisSerArgLeuSerGlnCysProGluValHisProLeuPro
ThrProValLeuLeuProAlaValAspPheSerLeuGlyGluTrpLysThrGlnMetGlu
GluThrLysAlaGlnAspIleLeuGlyAlaValThrLeuLeuLeuGluGlyValMetAla
AlaArgGlyGlnLeuGlyProThrCysLeuSerSerLeuLeuGlyGlnLeuSerGlyGln
ValArgLeuLeuLeuGlyAlaLeuGlnSerLeuLeuGlyThrGlnLeuProProGlnGly
ArgThrThrAlaHisLys SEQ ID NO:519 pMON28516

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaIlePheLeuSerPheGlnHisLeuLeuArgGlyLysVal
ArgPheLeuMetLeuValGlyGlySerThrLeuCysValArgGluPheGlyGlyAsnMet
AlaSerProAlaProProAlaCysAspLeuArgValLeuSerLysLeuLeuArgAspSer
HisValLeuHisSerArgLeuSerGlnCysProGluValHisProLeuProThrProVal
LeuLeuProAlaValAspPheSerLeuGlyGluTrpLysThrGlnMetGluGluThrLys
AlaGlnAspIleLeuGlyAlaValThrLeuLeuLeuGluGlyValMetAlaAlaArgGly
GlnLeuGlyProThrCysLeuSerSerLeuLeuGlyGlnLeuSerGlyGlnValArgLeu
LeuLeuGlyAlaLeuGlnSerLeuLeuGlyThrGlnLeuProProGlnGlyArgThrThr
AlaHisLysAspProAsn SEQ ID NO:520 pMON28519

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGluValHisProLeuProThrProValLeuLeuProAlaVal
AspPheSerLeuGlyGluTrpLysThrGlnMetGluGluThrLysAlaGlnAspIleLeu
GlyAlaValThrLeuLeuLeuGluGlyValMetAlaAlaArgGlyGlnLeuGlyProThr
CysLeuSerSerLeuLeuGlyGlnLeuSerGlyGlnValArgLeuLeuLeuGlyAlaLeu
GlnSerLeuLeuGlyThrGlnLeuProProGlnGlyArgThrThrAlaHisLysAspPro
AsnAlaIlePheLeuSerPheGlnHisLeuLeuArgGlyLysValArgPheLeuMetLeu
ValGlyGlySerThrLeuCysValArgGluPheGlyAsnMetAlaSerProAlaProPro
AlaCysAspLeuArgValLeuSerLysLeuLeuArgAspSerHisValLeuHisSerArg
LeuSerGlnCysPro SEQ ID NO:521

TABLE 3-continued
PROTEIN SEQUENCES pMON28520

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetLeuProThrProValLeuLeuProAlaValAspPheSerLeu
GlyGluTrpLysThrGlnMetGluGluThrLysAlaGlnAspIleLeuGlyAlaValThr
LeuLeuLeuGluGlyValMetAlaAlaArgGlyGlnLeuGlyProThrCysLeuSerSer
LeuLeuGlyGlnLeuSerGlyGlnValArgLeuLeuLeuGlyAlaLeuGlnSerLeuLeu
GlyThrGlnLeuProProGlnGlyArgThrThrAlaHisLysAspProAsnAlaIlePhe
LeuSerPheGlnHisLeuLeuArgGlyLysValArgPheLeuMetLeuValGlyGlySer
ThrLeuCysValArgGluPheGlyAsnMetAlaSerProAlaProProAlaCysAspLeu
ArgValLeuSerLysLeuLeuArgAspSerHisValLeuHisSerArgLeuSerGlnCys
ProGluValHisPro SEQ ID NO:522 pMON28521

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetValLeuLeuProAlaValAspPheSerLeuGlyGluTrpLys
ThrGlnMetGluGluThrLysAlaGlnAspIleLeuGlyAlaValThrLeuLeuLeuGlu
GlyValMetAlaAlaArgGlyGlnLeuGlyProThrCysLeuSerSerLeuLeuGlyGln
LeuSerGlyGlnValArgLeuLeuLeuGlyAlaLeuGlnSerLeuLeuGlyThrGlnLeu
ProProGlnGlyArgThrThrAlaHisLysAspProAsnAlaIlePheLeuSerPheGln
HisLeuLeuArgGlyLysValArgPheLeuMetLeuValGlyGlySerThrLeuCysVal
ArgGluPheGlyAsnMetAlaSerProAlaProProAlaCysAspLeuArgValLeuSer
LysLeuLeuArgAspSerHisValLeuHisSerArgLeuSerGlnCysProGluValHis
ProLeuProThrPro SEQ ID NO:523 pMON28522

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaValAspPheSerLeuGlyGluTrpLysThrGlnMetGlu
GluThrLysAlaGlnAspIleLeuGlyAlaValThrLeuLeuLeuGluGlyValMetAla
AlaArgGlyGlnLeuGlyProThrCysLeuSerSerLeuLeuGlyGlnLeuSerGlyGln
ValArgLeuLeuLeuGlyAlaLeuGlnSerLeuLeuGlyThrGlnLeuProProGlnGly
ArgThrThrAlaHisLysAspProAsnAlaIlePheLeuSerPheGlnHisLeuLeuArg
GlyLysValArgPheLeuMetLeuValGlyGlySerThrLeuCysValArgGluPheGly
AsnMetAlaSerProAlaProProAlaCysAspLeuArgValLeuSerLysLeuLeuArg
AspSerHisValLeuHisSerArgLeuSerGlnCysProGluValHisProLeuProThr
ProValLeuLeuPro SEQ ID NO:524 pMON28523

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAspPheSerLeuGlyGluTrpLysThrGlnMetGluGluThr
LysAlaGlnAspIleLeuGlyAlaValThrLeuLeuLeuGluGlyValMetAlaAlaArg
GlyGlnLeuGlyProThrCysLeuSerSerLeuLeuGlyGlnLeuSerGlyGlnValArg
LeuLeuLeuGlyAlaLeuGlnSerLeuLeuGlyThrGlnLeuProProGlnGlyArgThr
ThrAlaHisLysAspProAsnAlaIlePheLeuSerPheGlnHisLeuLeuArgGlyLys
ValArgPheLeuMetLeuValGlyGlySerThrLeuCysValArgGluPheGlyAsnMet
AlaSerProAlaProProAlaCysAspLeuArgValLeuSerLysLeuLeuArgAspSer
HisValLeuHisSerArgLeuSerGlnCysProGluValHisProLeuProThrProVal
LeuLeuProAlaVal SEQ ID NO:525

TABLE 3-continued

PROTEIN SEQUENCES pMON28524

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGlyGluTrpLysThrGlnMetGluGluThrLysAlaGlnAsp
IleLeuGlyAlaValThrLeuLeuLeuGluGlyValMetAlaAlaArgGlyGlnLeuGly
ProThrCysLeuSerSerLeuLeuGlyGlnLeuSerGlyGlnValArgLeuLeuLeuGly
AlaLeuGlnSerLeuLeuGlyThrGlnLeuProProGlnGlyArgThrThrAlaHisLys
AspProAsnAlaIlePheLeuSerPheGlnHisLeuLeuArgGlyLysValArgPheLeu
MetLeuValGlyGlySerThrLeuCysValArgGluPheGlyAsnMetAlaSerProAla
ProProAlaCysAspLeuArgValLeuSerLysLeuLeuArgAspSerHisValLeuHis
SerArgLeuSerGlnCysProGluValHisProLeuProThrProValLeuLeuProAla
ValAspPheSerLeu SEQ ID NO:526 pMON28525

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGlyProThrCysLeuSerSerLeuLeuGlyGlnLeuSerGly
GlnValArgLeuLeuLeuGlyAlaLeuGlnSerLeuLeuGlyThrGlnLeuProProGln
GlyArgThrThrAlaHisLysAspProAsnAlaIlePheLeuSerPheGlnHisLeuLeu
ArgGlyLysValArgPheLeuMetLeuValGlyGlySerThrLeuCysValArgGluPhe
GlyAsnMetAlaSerProAlaProProAlaCysAspLeuArgValLeuSerLysLeuLeu
ArgAspSerHisValLeuHisSerArgLeuSerGlnCysProGluValHisProLeuPro
ThrProValLeuLeuProAlaValAspPheSerLeuGlyGluTrpLysThrGlnMetGlu
GluThrLysAlaGlnAspIleLeuGlyAlaValThrLeuLeuLeuGluGlyValMetAla
AlaArgGlyGlnLeu SEQ ID NO:527 pMON28526

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGlyThrGlnLeuProProGlnGlyArgThrThrAlaHisLys
AspProAsnAlaIlePheLeuSerPheGlnHisLeuLeuArgGlyLysValArgPheLeu
MetLeuValGlyGlySerThrLeuCysValArgGluPheGlyAsnMetAlaSerProAla
ProProAlaCysAspLeuArgValLeuSerLysLeuLeuArgAspSerHisValLeuHis
SerArgLeuSerGlnCysProGluValHisProLeuProThrProValLeuLeuProAla
ValAspPheSerLeuGlyGluTrpLysThrGlnMetGluGluThrLysAlaGlnAspIle
LeuGlyAlaValThrLeuLeuLeuGluGlyValMetAlaAlaArgGlyGlnLeuGlyPro
ThrCysLeuSerSerLeuLeuGlyGlnLeuSerGlyGlnValArgLeuLeuLeuGlyAla
LeuGlnSerLeuLeu SEQ ID NO:528 pMON28527

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGlyArgThrThrAlaHisLysAspProAsnAlaIlePheLeu
SerPheGlnHisLeuLeuArgGlyLysValArgPheLeuMetLeuValGlyGlySerThr
LeuCysValArgGluPheGlyAsnMetAlaSerProAlaProProAlaCysAspLeuArg
ValLeuSerLysLeuLeuArgAspSerHisValLeuHisSerArgLeuSerGlnCysPro
GluValHisProLeuProThrProValLeuLeuProAlaValAspPheSerLeuGlyGlu
TrpLysThrGlnMetGluGluThrLysAlaGlnAspIleLeuGlyAlaValThrLeuLeu
LeuGluGlyValMetAlaAlaArgGlyGlnLeuGlyProThrCysLeuSerSerLeuLeu
GlyGlnLeuSerGlyGlnValArgLeuLeuLeuGlyAlaLeuGlnSerLeuLeuGlyThr
GlnLeuProProGln SEQ ID NO:529

TABLE 3-continued

PROTEIN SEQUENCES pMON28528

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaHisLysAspProAsnAlaIlePheLeuSerPheGlnHis
LeuLeuArgGlyLysValArgPheLeuMetLeuValGlyGlySerThrLeuCysValArg
GluPheGlyAsnMetAlaSerProAlaProProAlaCysAspLeuArgValLeuSerLys
LeuLeuArgAspSerHisValLeuHisSerArgLeuSerGlnCysProGluValHisPro
LeuProThrProValLeuLeuProAlaValAspPheSerLeuGlyGluTrpLysThrGln
MetGluGluThrLysAlaGlnAspIleLeuGlyAlaValThrLeuLeuLeuGluGlyVal
MetAlaAlaArgGlyGlnLeuGlyProThrCysLeuSerSerLeuLeuGlyGlnLeuSer
GlyGlnValArgLeuLeuLeuGlyAlaLeuGlnSerLeuLeuGlyThrGlnLeuProPro
GlnGlyArgThrThr SEQ ID NO:530 pMON28529

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAspProAsnAlaIlePheLeuSerPheGlnHisLeuLeuArg
GlyLysValArgPheLeuMetLeuValGlyGlySerThrLeuCysValArgGluPheGly
AsnMetAlaSerProAlaProProAlaCysAspLeuArgValLeuSerLysLeuLeuArg
AspSerHisValLeuHisSerArgLeuSerGlnCysProGluValHisProLeuProThr
ProValLeuLeuProAlaValAspPheSerLeuGlyGluTrpLysThrGlnMetGluGlu
ThrLysAlaGlnAspIleLeuGlyAlaValThrLeuLeuLeuGluGlyValMetAlaAla
ArgGlyGlnLeuGlyProThrCysLeuSerSerLeuLeuGlyGlnLeuSerGlyGlnVal
ArgLeuLeuLeuGlyAlaLeuGlnSerLeuLeuGlyThrGlnLeuProProGlnGlyArg
ThrThrAlaHisLys SEQ ID NO:531 pMON28530

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaIlePheLeuSerPheGlnHisLeuLeuArgGlyLysVal
ArgPheLeuMetLeuValGlyGlySerThrLeuCysValArgGluPheGlyAsnMetAla
SerProAlaProProAlaCysAspLeuArgValLeuSerLysLeuLeuArgAspSerHis
ValLeuHisSerArgLeuSerGlnCysProGluValHisProLeuProThrProValLeu
LeuProAlaValAspPheSerLeuGlyGluTrpLysThrGlnMetGluGluThrLysAla
GlnAspIleLeuGlyAlaValThrLeuLeuLeuGluGlyValMetAlaAlaArgGlyGln
LeuGlyProThrCysLeuSerSerLeuLeuGlyGlnLeuSerGlyGlnValArgLeuLeu
LeuGlyAlaLeuGlnSerLeuLeuGlyThrGlnLeuProProGlnGlyArgThrThrAla
HisLysAspProAsn SEQ ID NO:532 pMON28533

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGluValHisProLeuProThrProValLeuLeuProAlaVal
AspPheSerLeuGlyGluTrpLysThrGlnMetGluGluThrLysAlaGlnAspIleLeu
GlyAlaValThrLeuLeuLeuGluGlyValMetAlaAlaArgGlyGlnLeuGlyProThr
CysLeuSerSerLeuLeuGlyGlnLeuSerGlyGlnValArgLeuLeuLeuGlyAlaLeu
GlnSerLeuLeuGlyThrGlnLeuProProGlnGlyArgThrThrAlaHisLysAspPro
AsnAlaIlePheLeuSerPheGlnHisLeuLeuArgGlyLysValArgPheLeuMetLeu
ValGlyGlySerThrLeuCysValArgGluPheGlyGlyAsnGlyGlyAsnMetAlaSer
ProAlaProProAlaCysAspLeuArgValLeuSerLysLeuLeuArgAspSerHisVal
LeuHisSerArgLeuSerGlnCysPro SEQ ID NO:533

TABLE 3-continued

PROTEIN SEQUENCES pMON28534

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetLeuProThrProValLeuLeuProAlaValAspPheSerLeu
GlyGluTrpLysThrGlnMetGluGluThrLysAlaGlnAspIleLeuGlyAlaValThr
LeuLeuLeuGluGlyValMetAlaAlaArgGlyGlnLeuGlyProThrCysLeuSerSer
LeuLeuGlyGlnLeuSerGlyGlnValArgLeuLeuLeuGlyAlaLeuGlnSerLeuLeu
GlyThrGlnLeuProProGlnGlyArgThrThrAlaHisLysAspProAsnAlaIlePhe
LeuSerPheGlnHisLeuLeuArgGlyLysValArgPheLeuMetLeuValGlyGlySer
ThrLeuCysValArgGluPheGlyGlyAsnGlyGlyAsnMetAlaSerProAlaProPro
AlaCysAspLeuArgValLeuSerLysLeuLeuArgAspSerHisValLeuHisSerArg
LeuSerGlnCysProGluValHisPro SEQ ID NO:534 pMON28535

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetValLeuLeuProAlaValAspPheSerLeuGlyGluTrpLys
ThrGlnMetGluGluThrLysAlaGlnAspIleLeuGlyAlaValThrLeuLeuLeuGlu
GlyValMetAlaAlaArgGlyGlnLeuGlyProThrCysLeuSerSerLeuLeuGlyGln
LeuSerGlyGlnValArgLeuLeuLeuGlyAlaLeuGlnSerLeuLeuGlyThrGlnLeu
ProProGlnGlyArgThrThrAlaHisLysAspProAsnAlaIlePheLeuSerPheGln
HisLeuLeuArgGlyLysValArgPheLeuMetLeuValGlyGlySerThrLeuCysVal
ArgGluPheGlyGlyAsnGlyGlyAsnMetAlaSerProAlaProProAlaCysAspLeu
ArgValLeuSerLysLeuLeuArgAspSerHisValLeuHisSerArgLeuSerGlnCys
ProGluValHisProLeuProThrPro SEQ ID NO:535 pMON28536

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaValAspPheSerLeuGlyGluTrpLysThrGlnMetGlu
GluThrLysAlaGlnAspIleLeuGlyAlaValThrLeuLeuLeuGluGlyValMetAla
AlaArgGlyGlnLeuGlyProThrCysLeuSerSerLeuLeuGlyGlnLeuSerGlyGln
ValArgLeuLeuLeuGlyAlaLeuGlnSerLeuLeuGlyThrGlnLeuProProGlnGly
ArgThrThrAlaHisLysAspProAsnAlaIlePheLeuSerPheGlnHisLeuLeuArg
GlyLysValArgPheLeuMetLeuValGlyGlySerThrLeuCysValArgGluPheGly
GlyAsnGlyGlyAsnMetAlaSerProAlaProProAlaCysAspLeuArgValLeuSer
LysLeuLeuArgAspSerHisValLeuHisSerArgLeuSerGlnCysProGluValHis
ProLeuProThrProValLeuLeuPro SEQ ID NO:536 pMON28537

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAspPheSerLeuGlyGluTrpLysThrGlnMetGluGluThr
LysAlaGlnAspIleLeuGlyAlaValThrLeuLeuLeuGluGlyValMetAlaAlaArg
GlyGlnLeuGlyProThrCysLeuSerSerLeuLeuGlyGlnLeuSerGlyGlnValArg
LeuLeuLeuGlyAlaLeuGlnSerLeuLeuGlyThrGlnLeuProProGlnGlyArgThr
ThrAlaHisLysAspProAsnAlaIlePheLeuSerPheGlnHisLeuLeuArgGlyLys
ValArgPheLeuMetLeuValGlyGlySerThrLeuCysValArgGluPheGlyGlyAsn
GlyGlyAsnMetAlaSerProAlaProProAlaCysAspLeuArgValLeuSerLysLeu
LeuArgAspSerHisValLeuHisSerArgLeuSerGlnCysProGluValHisProLeu
ProThrProValLeuLeuProAlaVal SEQ ID NO:537

TABLE 3-continued

PROTEIN SEQUENCES pMON28538

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGlyGluTrpLysThrGlnMetGluGluThrLysAlaGlnAsp
IleLeuGlyAlaValThrLeuLeuLeuGluGlyValMetAlaAlaArgGlyGlnLeuGly
ProThrCysLeuSerSerLeuLeuGlyGlnLeuSerGlyGlnValArgLeuLeuLeuGly
AlaLeuGlnSerLeuLeuGlyThrGlnLeuProProGlnGlyArgThrThrAlaHisLys
AspProAsnAlaIlePheLeuSerPheGlnHisLeuLeuArgGlyLysValArgPheLeu
MetLeuValGlyGlySerThrLeuCysValArgGluPheGlyGlyAsnGlyGlyAsnMet
AlaSerProAlaProProAlaCysAspLeuArgValLeuSerLysLeuLeuArgAspSer
HisValLeuHisSerArgLeuSerGlnCysProGluValHisProLeuProThrProVal
LeuLeuProAlaValAspPheSerLeu SEQ ID NO:538 pMON28539

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGlyProThrCysLeuSerSerLeuLeuGlyGlnLeuSerGly
GlnValArgLeuLeuLeuGlyAlaLeuGlnSerLeuLeuGlyThrGlnLeuProProGln
GlyArgThrThrAlaHisLysAspProAsnAlaIlePheLeuSerPheGlnHisLeuLeu
ArgGlyLysValArgPheLeuMetLeuValGlyGlySerThrLeuCysValArgGluPhe
GlyGlyAsnGlyGlyAsnMetAlaSerProAlaProProAlaCysAspLeuArgValLeu
SerLysLeuLeuArgAspSerHisValLeuHisSerArgLeuSerGlnCysProGluVal
HisProLeuProThrProValLeuLeuProAlaValAspPheSerLeuGlyGluTrpLys
ThrGlnMetGluGluThrLysAlaGlnAspIleLeuGlyAlaValThrLeuLeuLeuGlu
GlyValMetAlaAlaArgGlyGlnLeu SEQ ID NO:539 pMON28540

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGlyThrGlnLeuProProGlnGlyArgThrThrAlaHisLys
AspProAsnAlaIlePheLeuSerPheGlnHisLeuLeuArgGlyLysValArgPheLeu
MetLeuValGlyGlySerThrLeuCysValArgGluPheGlyGlyAsnGlyGlyAsnMet
AlaSerProAlaProProAlaCysAspLeuArgValLeuSerLysLeuLeuArgAspSer
HisValLeuHisSerArgLeuSerGlnCysProGluValHisProLeuProThrProVal
LeuLeuProAlaValAspPheSerLeuGlyGluTrpLysThrGlnMetGluGluThrLys
AlaGlnAspIleLeuGlyAlaValThrLeuLeuLeuGluGlyValMetAlaAlaArgGly
GlnLeuGlyProThrCysLeuSerSerLeuLeuGlyGlnLeuSerGlyGlnValArgLeu
LeuLeuGlyAlaLeuGlnSerLeuLeu SEQ ID NO:540 pMON28541

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetGlyArgThrThrAlaHisLysAspProAsnAlaIlePheLeu
SerPheGlnHisLeuLeuArgGlyLysValArgPheLeuMetLeuValGlyGlySerThr
LeuCysValArgGluPheGlyGlyAsnGlyGlyAsnMetAlaSerProAlaProProAla
CysAspLeuArgValLeuSerLysLeuLeuArgAspSerHisValLeuHisSerArgLeu
SerGlnCysProGluValHisProLeuProThrProValLeuLeuProAlaValAspPhe
SerLeuGlyGluTrpLysThrGlnMetGluGluThrLysAlaGlnAspIleLeuGlyAla
ValThrLeuLeuLeuGluGlyValMetAlaAlaArgGlyGlnLeuGlyProThrCysLeu
SerSerLeuLeuGlyGlnLeuSerGlyGlnValArgLeuLeuLeuGlyAlaLeuGlnSer
LeuLeuGlyThrGlnLeuProProGln SEQ ID NO:541

TABLE 3-continued

PROTEIN SEQUENCES pMON28542

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaHisLysAspProAsnAlaIlePheLeuSerPheGlnHis
LeuLeuArgGlyLysValArgPheLeuMetLeuValGlyGlySerThrLeuCysValArg
GluPheGlyGlyAsnGlyGlyAsnMetAlaSerProAlaProProAlaCysAspLeuArg
ValLeuSerLysLeuLeuArgAspSerHisValLeuHisSerArgLeuSerGlnCysPro
GluValHisProLeuProThrProValLeuLeuProAlaValAspPheSerLeuGlyGlu
TrpLysThrGlnMetGluGluThrLysAlaGlnAspIleLeuGlyAlaValThrLeuLeu
LeuGluGlyValMetAlaAlaArgGlyGlnLeuGlyProThrCysLeuSerSerLeuLeu
GlyGlnLeuSerGlyGlnValArgLeuLeuLeuGlyAlaLeuGlnSerLeuLeuGlyThr
GlnLeuProProGlnGlyArgThrThr SEQ ID NO:542 pMON28543

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAspProAsnAlaIlePheLeuSerPheGlnHisLeuLeuArg
GlyLysValArgPheLeuMetLeuValGlyGlySerThrLeuCysValArgGluPheGly
GlyAsnGlyGlyAsnMetAlaSerProAlaProProAlaCysAspLeuArgValLeuSer
LysLeuLeuArgAspSerHisValLeuHisSerArgLeuSerGlnCysProGluValHis
ProLeuProThrProValLeuLeuProAlaValAspPheSerLeuGlyGluTrpLysThr
GlnMetGluGluThrLysAlaGlnAspIleLeuGlyAlaValThrLeuLeuLeuGluGly
ValMetAlaAlaArgGlyGlnLeuGlyProThrCysLeuSerSerLeuLeuGlyGlnLeu
SerGlyGlnValArgLeuLeuLeuGlyAlaLeuGlnSerLeuLeuGlyThrGlnLeuPro
ProGlnGlyArgThrThrAlaHisLys SEQ ID NO:543 pMON28544

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaIlePheLeuSerPheGlnHisLeuLeuArgGlyLysVal
ArgPheLeuMetLeuValGlyGlySerThrLeuCysValArgGluPheGlyGlyAsnGly
GlyAsnMetAlaSerProAlaProProAlaCysAspLeuArgValLeuSerLysLeuLeu
ArgAspSerHisValLeuHisSerArgLeuSerGlnCysProGluValHisProLeuPro
ThrProValLeuLeuProAlaValAspPheSerLeuGlyGluTrpLysThrGlnMetGlu
GluThrLysAlaGlnAspIleLeuGlyAlaValThrLeuLeuLeuGluGlyValMetAla
AlaArgGlyGlnLeuGlyProThrCysLeuSerSerLeuLeuGlyGlnLeuSerGlyGln
ValArgLeuLeuLeuGlyAlaLeuGlnSerLeuLeuGlyThrGlnLeuProProGlnGly
ArgThrThrAlaHisLysAspProAsn SEQ ID NO:544 pMON28545

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAspProAsnAlaIlePheLeuSerPheGlnHisLeuLeuArg
GlyLysValArgPheLeuMetLeuValGlyGlySerThrLeuCysValArgGluPheGly
GlyAsnMetAlaSerProAlaProProAlaCysAspLeuArgValLeuSerLysLeuLeu
ArgAspSerHisValLeuHisSerArgLeuSerGlnCysProGluValHisProLeuPro
ThrProValLeuLeuProAlaValAspPheSerLeuGlyGluTrpLysThrGlnMetGlu
GluThrLysAlaGlnAspIleLeuGlyAlaValThrLeuLeuLeuGluGlyValMetAla
AlaArgGlyGlnLeuGlyProThrCysLeuSerSerLeuLeuGlyGlnLeuSerGlyGln
ValArgLeuLeuLeuGlyAlaLeuGlnSerLeuLeuGlyThrGlnGlyArgThrThrAla
HisLys SEQ ID NO:545

TABLE 3-continued

PROTEIN SEQUENCES pMON32132

SerProAlaProProAlaCysAspLeuArgValLeuSerLysLeuLeuArgAspSerHis
ValLeuHisSerArgLeuSerGlnCysProGluValHisProLeuProThrProValLeu
LeuProAlaValAspPheSerLeuGlyGluTrpLysThrGlnMetGluGluThrLysAla
GlnAspIleLeuGlyAlaValThrLeuLeuLeuGluGlyValMetAlaAlaArgGlyGln
LeuGlyProThrCysLeuSerSerLeuLeuGlyGlnLeuSerGlyGlnValArgLeuLeu
LeuGlyAlaLeuGlnSerLeuLeuGlyThrGlnLeuProProGlnGlyArgThrThrAla
HisLysAspProAsnAlaIlePheLeuSerPheGlnHisLeuLeuArgGlyLysValArg
PheLeuMetLeuValGlyGlySerThrLeuCysValArg SEQ ID NO:546

PMON32133

SerProAlaProProAlaCysAspLeuArgValLeuSerLysLeuLeuArgAspSerHis
ValLeuHisSerArgLeuSerGlnCysProGluValHisProLeuProThrProValLeu
LeuProAlaValAspPheSerLeuGlyGluTrpLysThrGlnMetGluGluThrLysAla
GlnAspIleLeuGlyAlaValThrLeuLeuLeuGluGlyValMetAlaAlaArgGlyGln
LeuGlyProThrCysLeuSerSerLeuLeuGlyGlnLeuSerGlyGlnValArgLeuLeu
LeuGlyAlaLeuGlnSerLeuLeuGlyThrGlnLeuProProGlnGlyArgThrThrAlaHisLysAspPro
AsnAlaIlePheLeuSerPheGlnHisLeuLeuArgGlyLysValArgPheLeuMetLeu
ValGlyGlySerThrLeuCysValArg SEQ ID NO:547

PMON32134

SerProAlaProProAlaCysAspLeuArgValLeuSerLysLeuLeuArgAspSerHis
ValLeuHisSerArgLeuSerGlnCysProGluValHisProLeuProThrProValLeu
LeuProAlaValAspPheSerLeuGlyGluTrpLysThrGlnMetGluGluThrLysAla
GlnAspIleLeuGlyAlaValThrLeuLeuLeuGluGlyValMetAlaAlaArgGlyGln
LeuGlyProThrCysLeuSerSerLeuLeuGlyGlnLeuSerGlyGlnValArgLeuLeu
LeuGlyAlaLeuGlnSerLeuLeuGlyThrGlnLeuProProGlnGlyArgThrThrAla
HisLysAspProAsnAlaIlePheLeuSerPheGlnHisLeuLeuArgGlyLysValArg
PheLeuMetLeuValGlyGlySerThrLeuCysValArg SEQ ID NO:548 pMON30237.pep

AlaThrGlnAspCysSerPheGlnHisSerProIleSerSerAspPheAlaValLysIle
ArgGluLeuSerAspTyrLeuLeuGlnAspTyrProValThrValAlaSerAsnLeuGln
AspGluGluLeuCysGlyAlaLeuTrpArgLeuValLeuAlaGlnArgTrpMetGluArg
LeuLysThrValAlaGlySerLysMetGlnGlyLeuLeuGluArgValAsnThrGluIle
HisPheValThrLysCysAlaPheGlnProProProSerCysLeuArgPheValGlnThr
AsnIleSerArgLeuLeuGlnGluThrSerGluGlnLeuValAlaLeuLysProTrpIle
ThrArgGlnAsnPheSerArgCysLeuGluLeuGlnCysGlnPro
SEQ ID NO:549 pMON30238.pep

AlaThrGlnAspCysSerPheGlnHisSerProIleSerSerAspPheAlaValLysIle
ArgGluLeuSerAspTyrLeuLeuGlnAspTyrProValThrValAlaSerAsnLeuGln
AspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIle
HisPheValThrLysCysAlaPheGlnProProProSerCysLeuArgPheValGlnThr
AsnIleSerArgLeuLeuGlnGluThrSerGluGlnLeuValAlaLeuLysProTrpIle
ThrArgGlnAsnPheSerArgCysLeuGluLeuGlnCysGlnProAspSerSerThrLeu
SEQ ID NO:550 pMON30239.pep

AlaThrGlnAspCysSerPheGlnHisSerProIleSerSerAspPheAlaValLysIle
ArgGluLeuSerAspTyrLeuLeuGlnAspTyrProValThrValAlaSerAsnLeuGln
AspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIle
HisPheValThrLysCysAlaPheGlnGluThrSerGluGlnLeuValAlaLeuLysPro
TrpIleThrArgGlnAsnPheSerArgCysLeuGluLeuGlnCysGlnProAspSerSer
ThrLeu SEQ ID NO:551 pMON32329.pep

GlyThrGlnAspCysSerPheGlnHisSerProIleSerSerAspPheAlaValLysIle
ArgGluLeuSerAspTyrLeuLeuGlnAspTyrProValThrValAlaSerAsnLeuGln
AspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIle
HisPheValThrLysCysAlaPheGlnProProProSerCysLeuArgPheValGlnThr
AsnIleSerArgLeuLeuGlnGluThrSerGluGlnLeuValAlaLeuLysProTrpIle
ThrArgGlnAsnPheSerArgCysLeuGluLeuGlnCysGlnPro
SEQ ID NO:552

TABLE 3-continued

| PROTEIN SEQUENCES |
| --- | pMON32330.pep

GlyThrGlnAspCysSerPheGlnHisSerProIleSerSerAspPheAlaValLysIle
ArgGluLeuSerAspTyrLeuLeuGlnAspTyrProValThrValAlaSerAsnLeuGln
AspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIle
HisPheValThrLysCysAlaPheGlnProProProSerCysLeuArgPheValGlnThr
AsnIleSerArgLeuLeuGlnGluThrSerGluGlnLeuValAlaLeuLysProTrpIle
ThrArgGlnAsnPheSerArgCysLeuGluLeuGlnCysGlnProAspSerSerThrLeu
SEQ ID NO:553 pMON32341.pep

AlaThrGlnAspCysSerPheGlnHisSerProIleSerSerAspPheAlaValLysIle
ArgGluLeuSerAspTyrLeuLeuGlnAspTyrProValThrValAlaSerAsnLeuGln
AspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIle
HisPheValThrLysCysAlaPheGlnProProProSerCysLeuArgPheValGlnThr
AsnIleSerArgLeuLeuGlnGluThrSerGluGlnLeuValAlaLeuLysProTrpIle
ThrArgGlnAsnPheSerArgCysLeuGluLeuGlnCysGlnPro
SEQ ID NO:554 pMON32342.pep

AlaThrGlnAspCysSerPheGlnHisSerProIleSerSerAspPheAlaValLysIle
ArgGluLeuSerAspTyrLeuLeuGlnAspTyrProValThrValAlaSerAsnLeuGln
AspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIle
HisPheValThrLysCysAlaPheGlnProProProSerCysLeuArgPheValGlnThr
AsnIleSerArgLeuLeuGlnGluThrSerGluGlnLeuValAlaLeuLysProTrpIle
ThrArgGlnAsnPheSerArgCysLeuGluLeuGlnCysGlnProAspSerSerThrLeu
SEQ ID NO:555 pMON32320.pep

AlaAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuSerGlyGlyAsnGlySerGlyGlyAsnGlySerGlyGlyAsnGlyThrGlnAspCys
SerPheGlnHisSerProIleSerSerAspPheAlaValLysIleArgGluLeuSerAsp
TyrLeuLeuGlnAspTyrProValThrValAlaSerAsnLeuGln SEQ ID NO:556 pMON32321.pep

AlaAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuSerGlyGlyAsnGlySerGlyGlyAsnGlyThrGlnAspCysSerPheGlnHisSer
ProIleSerSerAspPheAlaValLysIleArgGluLeuSerAspTyrLeuLeuGlnAsp
TyrProValThrValAlaSerAsnLeuGln SEQ ID NO:557 pMON32322.pep

AlaAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuSerGlyGlyAsnGlyThrGlnAspCysSerPheGlnHisSerProIleSerSerAsp
PheAlaValLysIleArgGluLeuSerAspTyrLeuLeuGlnAspTyrProValThrVal
AlaSerAsnLeuGln SEQ ID NO:558 pMON32323.pep

AlaSerLysMetGlnGlyLeuLeuGluArgValAsnThrGluIleHisPheValThrLys
CysAlaPheGlnProProProSerCysLeuArgPheValGlnThrAsnIleSerArgLeu
LeuGlnGluThrSerGluGlnLeuValAlaLeuLysProTrpIleThrArgGlnAsnPhe
SerArgCysLeuGluLeuGlnCysGlnProAspSerSerThrLeuSerGlyGlyAsnGly
SerGlyGlyAsnGlySerGlyGlyAsnGlyThrGlnAspCysSerPheGlnHisSerPro
IleSerSerAspPheAlaValLysIleArgGluLeuSerAspTyrLeuLeuGlnAspTyr
ProValThrValAlaSerAsnLeuGlnAspGluGluLeuCysGlyGlyLeuTrpArgLeu
ValLeuAlaGlnArgTrpMetGluArgLeuLysThrValAlaGly SEQ ID NO:559

TABLE 3-continued

PROTEIN SEQUENCES pMON32324.pep

AlaSerLysMetGlnGlyLeuLeuGluArgValAsnThrGluIleHisPheValThrLys
CysAlaPheGlnProProProSerCysLeuArgPheValGlnThrAsnIleSerArgLeu
LeuGlnGluThrSerGluGlnLeuValAlaLeuLysProTrpIleThrArgGlnAsnPhe
SerArgCysLeuGluLeuGlnCysGlnProAspSerSerThrLeuSerGlyGlyAsnGly
SerGlyGlyAsnGlyThrGlnAspCysSerPheGlnHisSerProIleSerSerAspPhe
AlaValLysIleArgGluLeuSerAspTyrLeuLeuGlnAspTyrProValThrValAla
SerAsnLeuGlnAspGluGluLeuCysGlyGlyLeuTrpArgLeuValLeuAlaGlnArg
TrpMetGluArgLeuLysThrValAlaGly SEQ ID NO:560 pMON32325.pep

AlaSerLysMetGlnGlyLeuLeuGluArgValAsnThrGluIleHisPheValThrLys
CysAlaPheGlnProProProSerCysLeuArgPheValGlnThrAsnIleSerArgLeu
LeuGlnGluThrSerGluGlnLeuValAlaLeuLysProTrpIleThrArgGlnAsnPhe
SerArgCysLeuGluLeuGlnCysGlnProAspSerSerThrLeuSerGlyGlyAsnGly
ThrGlnAspCysSerPheGlnHisSerProIleSerSerAspPheAlaValLysIleArg
GluLeuSerAspTyrLeuLeuGlnAspTyrProValThrValAlaSerAsnLeuGlnAsp
GluGluLeuCysGlyGlyLeuTrpArgLeuValLeuAlaGlnArgTrpMetGluArgLeu
LysThrValAlaGly SEQ ID NO:561 pMON32326.pep

AlaProProSerCysLeuArgPheValGlnThrAsnIleSerArgLeuLeuGlnGluThr
SerGluGlnLeuValAlaLeuLysProTrpIleThrArgGlnAsnPheSerArgCysLeu
GluLeuGlnCysGlnProAspSerSerThrLeuSerGlyGlyAsnGlySerGlyGlyAsn
GlySerGlyGlyAsnGlyThrGlnAspCysSerPheGlnHisSerProIleSerSerAsp
PheAlaValLysIleArgGluLeuSerAspTyrLeuLeuGlnAspTyrProValThrVal
AlaSerAsnLeuGlnAspGluGluLeuCysGlyGlyLeuTrpArgLeuValLeuAlaGln
ArgTrpMetGluArgLeuLysThrValAlaGlySerLysMetGlnGlyLeuLeuGluArg
ValAsnThrGluIleHisPheValThrLysCysAlaPheGlnPro SEQ ID NO:562 pMON32327.pep

AlaProProSerCysLeuArgPheValGlnThrAsnIleSerArgLeuLeuGlnGluThr
SerGluGlnLeuValAlaLeuLysProTrpIleThrArgGlnAsnPheSerArgCysLeu
GluLeuGlnCysGlnProAspSerSerThrLeuSerGlyGlyAsnGlySerGlyGlyAsn
GlyThrGlnAspCysSerPheGlnHisSerProIleSerSerAspPheAlaValLysIle
ArgGluLeuSerAspTyrLeuLeuGlnAspTyrProValThrValAlaSerAsnLeuGln
AspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIle
HisPheValThrLysCysAlaPheGlnPro SEQ ID NO:563 pMON32328.pep

AlaProProSerCysLeuArgPheValGlnThrAsnIleSerArgLeuLeuGlnGluThr
SerGluGlnLeuValAlaLeuLysProTrpIleThrArgGlnAsnPheSerArgCysLeu
GluLeuGlnCysGlnProAspSerSerThrLeuSerGlyGlyAsnGlyThrGlnAspCys
SerPheGlnHisSerProIleSerSerAspPheAlaValLysIleArgGluLeuSerAsp
TyrLeuLeuGlnAspTyrProValThrValAlaSerAsnLeuGlnAspGluGluLeuCys
GlyGlyLeuTrpArgLeuValLeuAlaGlnArgTrpMetGluArgLeuLysThrValAla
GlySerLysMetGlnGlyLeuLeuGluArgValAsnThrGluIleHisPheValThrLys
CysAlaPheGlnPro SEQ ID NO:564 pMON32348.pep

AlaAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuSerGlyGlySerGlySerGlyGlySerGlySerGlyGlySerGlyThrGlnAspCys
SerPheGlnHisSerProIleSerSerAspPheAlaValLysIleArgGluLeuSerAsp
TyrLeuLeuGlnAspTyrProValThrValAlaSerAsnLeuGln SEQ ID NO:565 pMON32350.pep

AlaAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuSerGlyGlySerGlySerGlyGlySerGlyThrGlnAspCysSerPheGlnHisSer
ProIleSerSerAspPheAlaValLysIleArgGluLeuSerAspTyrLeuLeuGlnAsp
TyrProValThrValAlaSerAsnLeuGln SEQ ID NO:566

TABLE 3-continued

PROTEIN SEQUENCES

FLT3N.pep

MetAlaThrGlnAspCysSerPheGlnHisSerProIleSerSerAspPheAlaValLys
IleArgGluLeuSerAspTyrLeuLeuGlnAspTyrProValThrValAlaSerAsnLeu
GlnAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySer SEQ ID NO:567

FLT3C.pep

GlySerGlyGlyThrGlnAspCysSerPheGlnHisSerProIleSerSerAspPheAla
ValLysIleArgGluLeuSerAspTyrLeuLeuGlnAspTyrProValThrValAlaSer
AsnLeuGlnAspGluGluLeuCysGlyGlyLeuTrpArgLeuValLeuAlaGlnArgTrp
MetGluArgLeuLysThrValAlaGlySerLysMetGlnGlyLeuLeuGluArgValAsn
ThrGluIleHisPheValThrLysCysAlaPheGlnProProProSerCysLeuArgPhe
ValGlnThrAsnIleSerArgLeuLeuGlnGluThrSerGluGlnLeuValAlaLeuLys
ProTrpIleThrArgGlnAsnPheSerArgCysLeuGluLeuGlnCysGlnProAspSer
SerThrLeu SEQ ID NO:568

FLT7N.pep

MetAlaThrGlnAspCysSerPheGlnHisSerProIleSerSerAspPheAlaValLys
IleArgGluLeuSerAspTyrLeuLeuGlnAspTyrProValThrValAlaSerAsnLeu
GlnAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlySer SEQ ID NO:569

FLT4C.pep

GlySerGlyGlyGlyThrGlnAspCysSerPheGlnHisSerProIleSerSerAspPhe
AlaValLysIleArgGluLeuSerAspTyrLeuLeuGlnAspTyrProValThrValAla
SerAsnLeuGlnAspGluGluLeuCysGlyGlyLeuTrpArgLeuValLeuAlaGlnArg
TrpMetGluArgLeuLysThrValAlaGlySerLysMetGlnGlyLeuLeuGluArgVal
AsnThrGluIleHisPheValThrLysCysAlaPheGlnProProProSerCysLeuArg
PheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAsp
SerSerThrLeu SEQ ID NO:570

FLT11N.pep

MetAlaThrGlnAspCysSerPheGlnHisSerProIleSerSerAspPheAlaValLys
IleArgGluLeuSerAspTyrLeuLeuGlnAspTyrProValThrValAlaSerAsnLeu
GlnAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlySerGlyGlyGlySer SEQ ID NO:571

FLT10C.pep

GlySerGlyGlyGlySerGlyGlyGlySerGlyThrGlnAspCysSerPheGlnHisSer
ProIleSerSerAspPheAlaValLysIleArgGluLeuSerAspTyrLeuLeuGlnAsp
TyrProValThrValAlaSerAsnLeuGlnAspGluGluLeuCysGlyGlyLeuTrpArg
LeuValLeuAlaGlnArgTrpMetGluArgLeuLysThrValAlaGlySerLysMetGln
GlyLeuLeuGluArgValAsnThrGluIleHisPheValThrLysCysAlaPheGlnPro
ProProSerCysLeuArgPheValGlnThrAsnIleSerArgLeuLeuGlnGluThrSer
GluGlnLeuValAlaLeuLysProTrpIleThrArgGlnAsnPheSerArgCysLeuGlu
LeuGlnCysGlnProAspSerSerThrLeu SEQ ID NO:572 pMON32365.pep

AlaAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlyThrGlnAspCysSerPheGlnHisSerProIleSer
SerAspPheAlaValLysIleArgGluLeuSerAspTyrLeuLeuGlnAspTyrProValThr
ValAlaSerAsnLeuGln SEQ ID NO:573

TABLE 3-continued

| PROTEIN SEQUENCES |
|---| pMON32366.pep

AlaAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlyThrGlnAspCysSerPheGlnHisSerProIleSer
SerAspPheAlaValLysIleArgGluLeuSerAspTyrLeuLeuGlnAspTyrProVal
ThrValAlaSerAsnLeuGln SEQ ID NO:574 pMON32367.pep

AlaAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlySerGlyGlyThrGlnAspCysSerPheGlnHisSer
ProIleSerSerAspPheAlaValLysIleArgGluLeuSerAspTyrLeuLeuGlnAsp
TyrProValThrValAlaSerAsnLeuGln SEQ ID NO:575 pMON32368.pep

AlaAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlySerGlyGlyGlySerGlyThrGlnAspCysSerPhe
GlnHisSerProIleSerSerAspPheAlaValLysIleArgGluLeuSerAspTyrLeu
LeuGlnAspTyrProValThrValAlaSerAsnLeuGln SEQ ID NO:576 pMON32369.pep

AlaAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlySerGlyGlyGlySerGlyGlyGlyThrGlnAspCys
SerPheGlnHisSerProIleSerSerAspPheAlaValLysIleArgGluLeuSerAsp
TyrLeuLeuGlnAspTyrProValThrValAlaSerAsnLeuGln SEQ ID NO:577 pMON32370.pep

AlaAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGly
SerGlyThrGlnAspCysSerPheGlnHisSerProIleSerSerAspPheAlaValLys
IleArgGluLeuSerAspTyrLeuLeuGlnAspTyrProValThrValAlaSerAsnLeu
Gln SEQ ID NO:578 pMON30247.pep

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaThrGlnAspCysSerPheGlnHisSerProIleSerSer
AspPheAlaValLysIleArgGluLeuSerAspTyrLeuLeuGlnAspTyrProValThr
ValAlaSerAsnLeuGlnAspGluGluLeuCysGlyAlaLeuTrpArgLeuValLeuAla
GlnArgTrpMetGluArgLeuLysThrValAlaGlySerLysMetGlnGlyLeuLeuGlu
ArgValAsnThrGluIleHisPheValThrLysCysAlaPheGlnProProProSerCys
LeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGln
Pro SEQ ID NO:579

TABLE 3-continued

PROTEIN SEQUENCES pMON30248.pep

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaThrGlnAspCysSerPheGlnHisSerProIleSerSer
AspPheAlaValLysIleArgGluLeuSerAspTyrLeuLeuGlnAspTyrProValThr
ValAlaSerAsnLeuGlnAspGluGluLeuCysGlyAlaLeuTrpArgLeuValLeuAla
GlnArgTrpMetGluArgLeuLysThrValAlaGlySerLysMetGlnGlyLeuLeuGlu
ArgValAsnThrGluIleHisPheValThrLysCysAlaPheGlnProProProSerCys
LeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGln
ProAspSerSerThrLeu SEQ ID NO:580 pMON32332.pep

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspGluGluLeuCysGlyGlyLeuTrpArgLeuValLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCys
GlnProAspSerSerThrLeuSerGlyGlyAsnGlySerGlyGlyAsnGlyThrGlnAsp
CysSerPheGlnHisSerProIleSerSerAspPheAlaValLysIleArgGluLeuSer
AspTyrLeuLeuGlnAspTyrProValThrValAlaSerAsnLeuGln SEQ ID NO:581 pMON32333.pep

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspGluGluLeuCysGlyGlyLeuTrpArgLeuValLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCys
GlnProAspSerSerThrLeuSerGlyGlyAsnGlySerGlyGlyAsnGlyThrGlnAsp
CysSerPheGlnHisSerProIleSerSerAspPheAlaValLysIleArgGluLeuSer
AspTyrLeuLeuGlnAspTyrProValThrValAlaSerAsnLeuGln SEQ ID NO:582 pMON32334.pep

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaSerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuSerGlyGlyAsnGlyThrGlnAspCysSerPheGlnHisSerProIleSerSerAsp
PheAlaValLysIleArgGluLeuSerAspTyrLeuLeuGlnAspTyrProValThrVal
AlaSerAsnLeuGlnAspGluGluLeuCysGlyGlyLeuTrpArgLeuValLeuAlaGln
ArgTrpMetGluArgLeuLysThrValAlaGly SEQ ID NO:583 pMON32335.pep

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly

TABLE 3-continued

PROTEIN SEQUENCES

IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaSerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuSerGlyGlyAsnGlySerGlyGlyAsnGlyThrGlnAspCysSerPheGlnHisSer
ProIleSerSerAspPheAlaValLysIleArgGluLeuSerAspTyrLeuLeuGlnAsp
TyrProValThrValAlaSerAsnLeuGlnAspGluGluLeuCysGlyGlyLeuTrpArg
LeuValLeuAlaGlnArgTrpMetGluArgLeuLysThrValAlaGly SEQ ID NO:584 pMON32336.pep

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaGluLeuCysGlyGlyLeuTrpArgLeuValLeuLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCys
GlnProAspSerSerThrLeuSerGlyGlyAsnGlySerGlyGlyAsnGlySerGlyGly
AsnGlyThrGlnAspCysSerPheGlnHisSerProIleSerSerAspPheAlaValLys
IleArgGluLeuSerAspTyrLeuLeuGlnAspTyrProValThrValAlaSerAsnLeu
Gln SEQ ID NO:585 pMON32337.pep

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaProProSerCysLeuArgPheValGlnThrAsnIleSer
ArgLeuLeuGlnGluThrSerGluGlnLeuValAlaLeuLysProTrpIleThrArgGln
AsnPheSerArgCysLeuGluLeuGlnCysGlnProAspSerSerThrLeuSerGlyGly
AsnGlyThrGlnAspCysSerPheGlnHisSerProIleSerSerAspPheAlaValLys
IleArgGluLeuSerAspTyrLeuLeuGlnAspTyrProValThrValAlaSerAsnLeu
GlnAspGluGluLeuCysGlyGlyLeuTrpArgLeuValLeuLeuAlaGlnArgTrpMetGlu
ArgLeuLysThrValAlaGlySerLysMetGlnGlyLeuLeuGluArgValAsnThrGlu
IleHisPheValThrLysCysAlaPheGlnPro SEQ ID NO:586 pMON32338.pep

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaProProSerCysLeuArgPheValGlnThrAsnIleSer
ArgLeuLeuGlnGluThrSerGluGlnLeuValAlaLeuLysProTrpIleThrArgGln
AsnPheSerArgCysLeuGluLeuGlnCysGlnProAspSerSerThrLeuSerGlyGly
AsnGlySerGlyGlyAsnGlyThrGlnAspCysSerPheGlnHisSerProIleSerSer
AspPheAlaValLysIleArgGluLeuSerAspTyrLeuLeuGlnAspTyrProValThr
ValAlaSerAsnLeuGlnAspGluGluLeuCysGlyGlyLeuTrpArgLeuValLeuAla
GlnArgTrpMetGluArgLeuLysThrValAlaGlySerLysMetGlnGlyLeuLeuGlu
ArgValAsnThrGluIleHisPheValThrLysCysAlaPheGlnPro SEQ ID NO:587 pMON32339.pep

AlaAsnCysSerIleMetIleAspGluIleIleHisHisLeuLysArgProProAlaPro
LeuLeuAspProAsnAsnLeuAsnAspGluAspValSerIleLeuMetAspArgAsnLeu
ArgLeuProAsnLeuGluSerPheValArgAlaValLysAsnLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer

TABLE 3-continued

PROTEIN SEQUENCES

HisLysSerProAsnMetAlaProProSerCysLeuArgPheValGlnThrAsnIleSer
ArgLeuLeuGlnGluThrSerGluGlnLeuValAlaLeuLysProTrpIleThrArgGln
AsnPheSerArgCysLeuGluLeuGlnCysGlnProAspSerSerThrLeuSerGlyGly
AsnGlySerGlyGlyAsnGlySerGlyGlyAsnGlyThrGlnAspCysSerPheGlnHis
SerProIleSerSerAspPheAlaValLysIleArgGluLeuSerAspTyrLeuLeuGln
AspTyrProValThrValAlaSerAsnLeuGlnAspGluGluLeuCysGlyGlyLeuTrp
ArgLeuValLeuAlaGlnArgTrpMetGluArgLeuLysThrValAlaGlySerLysMet
GlnGlyLeuLeuGluArgValAsnThrGluIleHisPheValThrLysCysAlaPheGln
Pro SEQ ID NO:588 pMON32364.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaThrGlnAspCysSerPheGlnHisSerProIleSerSer
AspPheAlaValLysIleArgGluLeuSerAspTyrLeuLeuGlnAspTyrProValThr
ValAlaSerAsnLeuGlnAspGluGluLeuCysGlyGlyLeuTrpArgLeuValLeuAla
GlnArgTrpMetGluArgLeuLysThrValAlaGlySerLysMetGlnGlyLeuLeuGlu
ArgValAsnThrGluIleHisPheValThrLysCysAlaPheGlnProProProSerCys
LeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGln
Pro SEQ ID NO:589 pMON32377.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaThrGlnAspCysSerPheGlnHisSerProIleSerSer
AspPheAlaValLysIleArgGluLeuSerAspTyrLeuLeuGlnAspTyrProValThr
ValAlaSerAsnLeuGlnAspGluGluLeuCysGlyGlyLeuTrpArgLeuValLeuAla
GlnArgTrpMetGluArgLeuLysThrValAlaGlySerLysMetGlnGlyLeuLeuGlu
ArgValAsnThrGluIleHisPheValThrLysCysAlaPheGlnProProProSerCys
LeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGln
ProAspSerSerThrLeu SEQ ID NO:590 pMON32352.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspGluGluLeuCysGlyGlyLeuTrpArgLeuValLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCys
GlnProAspSerSerThrLeuSerGlyGlyAsnGlySerGlyGlyAsnGlyThrGlnAsp
CysSerPheGlnHisSerProIleSerSerAspPheAlaValLysIleArgGluLeuSer
AspTyrLeuLeuGlnAspTyrProValThrValAlaSerAsnLeuGln SEQ ID NO:591 pMON32353.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspGluGluLeuCysGlyGlyLeuTrpArgLeuValLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu

TABLE 3-continued

PROTEIN SEQUENCES

ValAlaLeuLysProTrpIleThrArgGlnAsnPheSerArgCysLeuGluLeuGlnCys
GlnProAspSerSerThrLeuSerGlyGlyAsnGlySerGlyGlyAsnGlySerGlyGly
AsnGlyThrGlnAspCysSerPheGlnHisSerProIleSerSerAspPheAlaValLys
IleArgGluLeuSerAspTyrLeuLeuGlnAspTyrProValThrValAlaSerAsnLeu
Gln SEQ ID NO:592 pMON32354.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaSerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuSerGlyGlyAsnGlyThrGlnAspCysSerPheGlnHisSerProIleSerSerAsp
PheAlaValLysIleArgGluLeuSerAspTyrLeuLeuGlnAspTyrProValThrVal
AlaSerAsnLeuGlnAspGluGluLeuCysGlyGlyLeuTrpArgLeuValLeuAlaGln
ArgTrpMetGluArgLeuLysThrValAlaGly SEQ ID NO:593 pMON32355.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaSerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuSerGlyGlyAsnGlySerGlyGlyAsnGlyThrGlnAspCysSerPheGlnHisSer
ProIleSerSerAspPheAlaValLysIleArgGluLeuSerAspTyrLeuLeuGlnAsp
TyrProValThrValAlaSerAsnLeuGlnAspGluGluLeuCysGlyGlyLeuTrpArg
LeuValLeuAlaGlnArgTrpMetGluArgLeuLysThrValAlaGly SEQ ID NO:594 pMON32356.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaSerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuSerGlyGlyAsnGlySerGlyGlyAsnGlySerGlyGlyThrGlnAspCys
SerPheGlnHisSerProIleSerSerAspPheAlaValLysIleArgGluLeuSerAsp
TyrLeuLeuGlnAspTyrProValThrValAlaSerAsnLeuGlnAspGluGluLeuCys
GlyGlyLeuTrpArgLeuValLeuAlaGlnArgTrpMetGluArgLeuLysThrValAla
Gly SEQ ID NO:595 pMON32357.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaProProSerCysLeuArgPheValGlnThrAsnIleSer
ArgLeuLeuGlnGluThrSerGluGlnLeuValAlaLeuLysProTrpIleThrArgGln
AsnPheSerArgCysLeuGluLeuGlnCysGlnProAspSerSerThrLeuSerGlyGly
AsnGlyThrGlnAspCysSerPheGlnHisSerProIleSerSerAspPheAlaValLys
IleArgGluLeuSerAspTyrLeuLeuGlnAspTyrProValThrValAlaSerAsnLeu
GlnAspGluGluLeuCysGlyGlyLeuTrpArgLeuValLeuAlaGlnArgTrpMetGlu

TABLE 3-continued

PROTEIN SEQUENCES

ArgLeuLysThrValAlaGlySerLysMetGlnGlyLeuLeuGluArgValAsnThrGlu
IleHisPheValThrLysCysAlaPheGlnPro SEQ ID NO:596 pMON32358.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaProProSerCysLeuArgPheValGlnThrAsnIleSer
ArgLeuLeuGlnGluThrSerGluGlnLeuValAlaLeuLysProTrpIleThrArgGln
AsnPheSerArgCysLeuGluLeuGlnCysGlnProAspSerSerThrLeuSerGlyGly
AsnGlySerGlyGlyAsnGlyThrGlnAspCysSerPheGlnHisSerProIleSerSer
AspPheAlaValLysIleArgGluLeuSerAspTyrLeuLeuGlnAspTyrProValThr
ValAlaSerAsnLeuGlnAspGluGluLeuCysGlyGlyLeuTrpArgLeuValLeuAla
GlnArgTrpMetGluArgLeuLysThrValAlaGlySerLysMetGlnGlyLeuLeuGlu
ArgValAsnThrGluIleHisPheValThrLysCysAlaPheGlnPro SEQ ID NO:597 pMON32359.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaProProSerCysLeuArgPheValGlnThrAsnIleSer
ArgLeuLeuGlnGluThrSerGluGlnLeuValAlaLeuLysProTrpIleThrArgGln
AsnPheSerArgCysLeuGluLeuGlnCysGlnProAspSerSerThrLeuSerGlyGly
AsnGlySerGlyGlyAsnGlySerGlyGlyAsnGlyThrGlnAspCysSerPheGlnHis
SerProIleSerSerAspPheAlaValLysIleArgGluLeuSerAspTyrLeuLeuGln
AspTyrProValThrValAlaSerAsnLeuGlnAspGluGluLeuCysGlyGlyLeuTrp
ArgLeuValLeuAlaGlnArgTrpMetGluArgLeuLysThrValAlaGlySerLysMet
GlnGlyLeuLeuGluArgValAsnThrGluIleHisPheValThrLysCysAlaPheGln
Pro SEQ ID NO:598 pMON32360.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspGluGluLeuCysGlyGlyLeuTrpArgLeuValLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCys
GlnProAspSerSerThrLeuSerGlyGlySerGlySerGlyGlySerGlyThrGlnAsp
CysSerPheGlnHisSerProIleSerSerAspPheAlaValLysIleArgGluLeuSer
AspTyrLeuLeuGlnAspTyrProValThrValAlaSerAsnLeuGln SEQ ID NO:599 pMON32362.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspGluLeuCysGlyGlyLeuTrpArgLeuValLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCys
GlnProAspSerSerThrLeuSerGlyGlySerGlySerGlyGlySerGlyGlySerGlyGly
SerGlyThrGlnAspCysSerPheGlnHisSerProIleSerSerAspPheAlaValLys
IleArgGluLeuSerAspTyrLeuLeuGlnAspTyrProValThrValAlaSerAsnLeu
Gln SEQ ID NO:600

TABLE 3-continued

PROTEIN SEQUENCES pMON32392.pep

AlaThrGlnAspCysSerPheGlnHisSerProIleSerSerAspPheAlaValLysIle
ArgGluLeuSerAspTyrLeuLeuGlnAspTyrProValThrValAlaSerAsnLeuGln
AspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIle
HisPheValThrLysCysAlaPheGlnProProProSerCysLeuArgPheValGlnThr
AsnIleSerArgLeuLeuGlnGluThrSerGluGlnLeuValAlaLeuLysProTrpIle
ThrArgGlnAsnPheSerArgCysLeuGluLeuGlnCysGlnProTyrValGluGlyGly
GlyGlySerProGlyGluProSerGlyProIleSerThrIleAsnProSerProProSer
LysGluSerHisLysSerProAsnMetAlaAsnCysSerIleMetIleAspGluIleIle
HisHisLeuLysArgProProAsnProLeuLeuAspProAsnAsnLeuAsnSerGluAsp
MetAspIleLeuMetGluArgAsnLeuArgThrProAsnLeuLeuAlaPheValArgAla
ValLysHisLeuGluAsnAlaSerGlyIleGluAlaIleLeuArgAsnLeuGlnProCys
LeuProSerAlaThrAlaAlaProSerArgHisProIleIleIleLysAlaGlyAspTrp
GlnGluPheArgGluLysLeuThrPheTyrLeuValThrLeuGluGlnAlaGlnGluGln
Gln SEQ ID NO:601 pMON32393.pep

AlaThrGlnAspCysSerPheGlnHisSerProIleSerSerAspPheAlaValLysIle
ArgGluLeuSerAspTyrLeuLeuGlnAspTyrProValThrValAlaSerAsnLeuGln
AspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIle
HisPheValThrLysCysAlaPheGlnProProProSerCysLeuArgPheValGlnThr
AsnIleSerArgLeuLeuGlnGluThrSerGluGlnLeuValAlaLeuLysProTrpIle
ThrArgGlnAsnPheSerArgCysLeuGluLeuGlnCysGlnProAspSerSerThrLeu
TyrValGluGlyGlyGlyGlySerProGlyGluProSerGlyProIleSerThrIleAsn
ProSerProProSerLysGluSerHisLysSerProAsnMetAlaAsnCysSerIleMet
IleAspGluIleIleHisHisLeuLysArgProProAsnProLeuLeuAspProAsnAsn
LeuAsnSerGluAspMetAspIleLeuMetGluArgAsnLeuArgThrProAsnLeuLeu
AlaPheValArgAlaValLysHisLeuGluAsnAlaSerGlyIleGluAlaIleLeuArg
AsnLeuGlnProCysLeuProSerAlaThrAlaAlaProSerArgHisProIleIleIle
LysAlaGlyAspTrpGlnGluPheArgGluLysLeuThrPheTyrLeuValThrLeuGlu
GlnAlaGlnGluGlnGln SEQ ID NO:602 pMON32396.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ProHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaThrGlnAspCysSerPheGlnHisSerProIleSerSer
AspPheAlaValLysIleArgGluLeuSerAspTyrLeuLeuGlnAspTyrProValThr
ValAlaSerAsnLeuGlnAspGluGluLeuCysGlyGlyLeuTrpArgLeuValLeuAla
GlnArgTrpMetGluArgLeuLysThrValAlaGlySerLysMetGlnGlyLeuLeuGlu
ArgValAsnThrGluIleHisPheValThrLysCysAlaPheGlnGluThrSerGluGln
LeuValAlaLeuLysProTrpIleThrArgGlnAsnPheSerArgCysLeuGluLeuGln
CysGlnProAspSerSerThrLeu SEQ ID NO:603 pMON32371.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspGluGluLeuCysGlyGlyLeuTrpArgLeuValLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCys
GlnProAspSerSerThrLeuGlyGlyGlySerGlyGlyThrGlnAspCysSerPheGln
HisSerProIleSerSerAspPheAlaValLysIleArgGluLeuSerAspTyrLeuLeu
GlnAspTyrProValThrValAlaSerAsnLeuGln SEQ ID NO:604 pMON32372.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer

TABLE 3-continued

PROTEIN SEQUENCES

ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlySer
ProGlyGluProSerGlyProIleSerThrIleAsnProSerProProSerLysGluSer
HisLysSerProAsnMetAlaAspGluGluLeuCysGlyGlyLeuTrpArgLeuValLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCys
GlnProAspSerSerThrLeuGlyGlyGlySerGlyGlyGlyThrGlnAspCysSerPhe
GlnHisSerProIleSerSerAspPheAlaValLysIleArgGluLeuSerAspTyrLeu
LeuGlnAspTyrProValThrValAlaSerAsnLeuGln SEQ ID NO:605 pMON32373.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspGluGluLeuCysGlyGlyLeuTrpArgLeuValLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCys
GlnProAspSerSerThrLeuGlyGlyGlySerGlyGlyGlySerGlyGlyThrGlnAsp
CysSerPheGlnHisSerProIleSerSerAspPheAlaValLysIleArgGluLeuSer
AspTyrLeuLeuGlnAspTyrProValThrValAlaSerAsnLeuGln SEQ ID NO:606 pMON32374.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspGluGluLeuCysGlyGlyLeuTrpArgLeuValLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCys
GlnProAspSerSerThrLeuGlyGlyGlySerGlyGlyGlySerGlyGlyGlySerGly
ThrGlnAspCysSerPheGlnHisSerProIleSerSerAspPheAlaValLysIleArg
GluLeuSerAspTyrLeuLeuGlnAspTyrProValThrValAlaSerAsnLeuGln
SEQ ID NO:607 pMON32375.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspGluGluLeuCysGlyGlyLeuTrpArgLeuValLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCys
GlnProAspSerSerThrLeuGlyGlyGlySerGlyGlyGlySerGlyGlyGlySerGly
GlyGlyThrGlnAspCysSerPheGlnHisSerProIleSerSerAspPheAlaValLys
IleArgGluLeuSerAspTyrLeuLeuGlnAspTyrProValThrValAlaSerAsnLeu
Gln SEQ ID NO:608 pMON32376.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer

TABLE 3-continued

PROTEIN SEQUENCES

HisLysSerProAsnMetAlaAspGluGluLeuCysGlyGlyLeuTrpArgLeuValLeu
AlaGlnArgTrpMetGluArgLeuLysThrValAlaGlySerLysMetGlnGlyLeuLeu
GluArgValAsnThrGluIleHisPheValThrLysCysAlaPheGlnProProProSer
CysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCys
GlnProAspSerSerThrLeuGlyGlyGlySerGlyGlyGlySerGlyGlyGlySerGly
GlyGlySerGlyGlyGlySerGlyThrGlnAspCysSerPheGlnHisSerProIleSer
SerAspPheAlaValLysIleArgGluLeuSerAspTyrLeuLeuGlnAspTyrProVal
ThrValAlaSerAsnLeuGln SEQ ID NO:609 pMON32378.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaSerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlyThrGlnAspCysSerPheGlnHisSerProIleSer
SerAspPheAlaValLysIleArgGluLeuSerAspTyrLeuLeuGlnAspTyrProValThr
ValAlaSerAsnLeuGlnAspGluGluLeuCysGlyGlyLeuTrpArgLeuValLeuAla
GlnArgTrpMetGluArgLeuLysThrValAlaGly SEQ ID NO:610 pMON32379.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaSerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlyThrGlnAspCysSerPheGlnHisSerProIleSer
SerAspPheAlaValLysIleArgGluLeuSerAspTyrLeuLeuGlnAspTyrProVal
ThrValAlaSerAsnLeuGlnAspGluGluLeuCysGlyGlyLeuTrpArgLeuValLeu
AlaGlnArgTrpMetGluArgLeuLysThrValAlaGly SEQ ID NO:611 pMON32380.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaSerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlySerGlyGlyThrGlnAspCysSerPheGlnHisSer
ProIleSerSerAspPheAlaValLysIleArgGluLeuSerAspTyrLeuLeuGlnAsp
TyrProValThrValAlaSerAsnLeuGlnAspGluGluLeuCysGlyGlyLeuTrpArg
LeuValLeuAlaGlnArgTrpMetGluArgLeuLysThrValAlaGly SEQ ID NO:612 pMON32381.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaSerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr

TABLE 3-continued

PROTEIN SEQUENCES

LeuGlyGlyGlySerGlyGlyGlySerGlyGlyGlySerGlyThrGlnAspCysSerPhe
GlnHisSerProIleSerSerAspPheAlaValLysIleArgGluLeuSerAspTyrLeu
LeuGlnAspTyrProValThrValAlaSerAsnLeuGlnAspGluGluLeuCysGlyGly
LeuTrpArgLeuValLeuAlaGlnArgTrpMetGluArgLeuLysThrValAlaGly
SEQ ID NO:613 pMON32382.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaSerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlySerGlyGlyGlySerGlyGlyGlyThrGlnAspCys
SerPheGlnHisSerProIleSerSerAspPheAlaValLysIleArgGluLeuSerAsp
TyrLeuLeuGlnAspTyrProValThrValAlaSerAsnLeuGlnAspGluGluLeuCys
GlyGlyLeuTrpArgLeuValLeuAlaGlnArgTrpMetGluArgLeuLysThrValAla
Gly SEQ ID NO:614 pMON32383.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaSerLysMetGlnGlyLeuLeuGluArgValAsnThrGlu
IleHisPheValThrLysCysAlaPheGlnProProProSerCysLeuArgPheValGln
ThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThr
LeuGlyGlyGlySerGlyGlyGlySerGlyGlyGlySerGlyGlyGly
SerGlyThrGlnAspCysSerPheGlnHisSerProIleSerSerAspPheAlaValLys
IleArgGluLeuSerAspTyrLeuLeuGlnAspTyrProValThrValAlaSerAsnLeu
GlnAspGluGluLeuCysGlyGlyLeuTrpArgLeuValLeuAlaGlnArgTrpMetGlu
ArgLeuLysThrValAlaGly SEQ ID NO:615 pMON32384.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaProProSerCysLeuArgPheValGlnThrAsnIleSer
ArgLeuLeuGlnGluThrSerGluGlnLeuValAlaLeuLysProTrpIleThrArgGln
AsnPheSerArgCysLeuGluLeuGlnCysGlnProAspSerSerThrLeuGlyGlyGly
SerGlyGlyThrGlnAspCysSerPheGlnHisSerProIleSerSerAspPheAlaVal
LysIleArgGluLeuSerAspTyrLeuLeuGlnAspTyrProValThrValAlaSerAsn
LeuGlnAspGluGluLeuCysGlyGlyLeuTrpArgLeuValLeuAlaGlnArgTrpMet
GluArgLeuLysThrValAlaGlySerLysMetGlnGlyLeuLeuGluArgValAsnThr
GluIleHisPheValThrLysCysAlaPheGlnPro SEQ ID NO:616 pMON32385.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaProProSerCysLeuArgPheValGlnThrAsnIleSer
ArgLeuLeuGlnGluThrSerGluGlnLeuValAlaLeuLysProTrpIleThrArgGln
AsnPheSerArgCysLeuGluLeuGlnCysGlnProAspSerSerThrLeuGlyGlyGly
SerGlyGlyGlyThrGlnAspCysSerPheGlnHisSerProIleSerSerAspPheAla
ValLysIleArgGluLeuSerAspTyrLeuLeuGlnAspTyrProValThrValAlaSer
AsnLeuGlnAspGluGluLeuCysGlyGlyLeuTrpArgLeuValLeuAlaGlnArgTrp

| TABLE 3-continued |
|---|
| PROTEIN SEQUENCES |

MetGluArgLeuLysThrValAlaGlySerLysMetGlnGlyLeuLeuGluArgValAsn
ThrGluIleHisPheValThrLysCysAlaPheGlnPro SEQ ID NO:617 pMON32386.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaProProSerCysLeuArgPheValGlnThrAsnIleSer
ArgLeuLeuGlnGluThrSerGluGlnLeuValAlaLeuLysProTrpIleThrArgGln
AsnPheSerArgCysLeuGluLeuGlnCysGlnProAspSerSerThrLeuGlyGlyGly
SerGlyGlyGlySerGlyGlyThrGlnAspCysSerPheGlnHisSerProIleSerSer
AspPheAlaValLysIleArgGluLeuSerAspTyrLeuLeuGlnAspTyrProValThr
ValAlaSerAsnLeuGlnAspGluGluLeuCysGlyGlyLeuTrpArgLeuValLeuAla
GlnArgTrpMetGluArgLeuLysThrValAlaGlySerLysMetGlnGlyLeuLeuGlu
ArgValAsnThrGluIleHisPheValThrLysCysAlaPheGlnPro SEQ ID NO:618 pMON32387.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaProProSerCysLeuArgPheValGlnThrAsnIleSer
ArgLeuLeuGlnGluThrSerGluGlnLeuValAlaLeuLysProTrpIleThrArgGln
AsnPheSerArgCysLeuGluLeuGlnCysGlnProAspSerSerThrLeuGlyGlyGly
SerGlyGlyGlySerGlyGlyGlySerGlyThrGlnAspCysSerPheGlnHisSerPro
IleSerSerAspPheAlaValLysIleArgGluLeuSerAspTyrLeuLeuGlnAspTyr
ProValThrValAlaSerAsnLeuGlnAspGluGluLeuCysGlyGlyLeuTrpArgLeu
ValLeuAlaGlnArgTrpMetGluArgLeuLysThrValAlaGlySerLysMetGlnGly
LeuLeuGluArgValAsnThrGluIleHisPheValThrLysCysAlaPheGlnPro
SEQ ID NO:619 pMON32388.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaProProSerCysLeuArgPheValGlnThrAsnIleSer
ArgLeuLeuGlnGluThrSerGluGlnLeuValAlaLeuLysProTrpIleThrArgGln
AsnPheSerArgCysLeuGluLeuGlnCysGlnProAspSerSerThrLeuGlyGlyGly
SerGlyGlyGlySerGlyGlyGlySerGlyGlyGlyThrGlnAspCysSerPheGlnHis
SerProIleSerSerAspPheAlaValLysIleArgGluLeuSerAspTyrLeuLeuGln
AspTyrProValThrValAlaSerAsnLeuGlnAspGluGluLeuCysGlyGlyLeuTrp
ArgLeuValLeuAlaGlnArgTrpMetGluArgLeuLysThrValAlaGlySerLysMet
GlnGlyLeuLeuGluArgValAsnThrGluIleHisPheValThrLysCysAlaPheGln
Pro SEQ ID NO:620 pMON32389.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaProProSerCysLeuArgPheValGlnThrAsnIleSer
ArgLeuLeuGlnGluThrSerGluGlnLeuValAlaLeuLysProTrpIleThrArgGln
AsnPheSerArgCysLeuGluLeuGlnCysGlnProAspSerSerThrLeuGlyGlyGly
SerGlyGlyGlySerGlyGlyGlySerGlyGlyGlySerGlyGlyGlySerGlyThrGln
AspCysSerPheGlnHisSerProIleSerSerAspPheAlaValLysIleArgGluLeu
SerAspTyrLeuLeuGlnAspTyrProValThrValAlaSerAsnLeuGlnAspGluGlu
LeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheVal
ThrLysCysAlaPheGlnPro SEQ ID NO:621

TABLE 3-continued

PROTEIN SEQUENCES hflt3-2829link10.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspTyrProValThrValAlaSerAsnLeuGlnAspGlu
GluLeuCysGlyGlyLeuTrpArgLeuValLeuAlaGlnArgTrpMetGluArgLeuLys
ThrValAlaGlySerLysMetGlnGlyLeuLeuGluArgValAsnThrGluIleHisPhe
ValThrLysCysAlaPheGlnProProProSerCysLeuArgPheValGlnThrAsnIle
SerArgLeuLeuGlnGluThrSerGluGlnLeuValAlaLeuLysProTrpIleThrArg
GlnAsnPheSerArgCysLeuGluLeuGlnCysGlnProAspSerSerThrLeuGlyGly
GlySerGlyGlyGlySerGlyGlyThrGlnAspCysSerPheGlnHisSerProIleSer
SerAspPheAlaValLysIleArgGluLeuSerAspTyrLeuLeuGln SEQ ID NO:622 hflt3-2829link15.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspTyrProValThrValAlaSerAsnLeuGlnAspGlu
GluLeuCysGlyGlyLeuTrpArgLeuValLeuAlaGlnArgTrpMetGluArgLeuLys
ThrValAlaGlySerLysMetGlnGlyLeuLeuGluArgValAsnThrGluIleHisPhe
ValThrLysCysAlaPheGlnProProProSerCysLeuArgPheValGlnThrAsnIle
SerArgLeuLeuGlnGluThrSerGluGlnLeuValAlaLeuLysProTrpIleThrArg
GlnAsnPheSerArgCysLeuGluLeuGlnCysGlnProAspSerSerThrLeuGlyGly
GlySerGlyGlyGlySerGlyGlyGlySerGlyGlyGlyThrGlnAspCysSerPheGln
HisSerProIleSerSerAspPheAlaValLysIleArgGluLeuSerAspTyrLeuLeu
Gln SEQ ID NO:623 hflt3-3435link10.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAlaSerAsnLeuGlnAspGluGluLeuCysGlyGlyLeu
TrpArgLeuValLeuAlaGlnArgTrpMetGluArgLeuLysThrValAlaGlySerLys
MetGlnGlyLeuLeuGluArgValAsnThrGluIleHisPheValThrLysCysAlaPhe
GlnProProProSerCysLeuArgPheValGlnThrAsnIleSerArgLeuLeuGlnGlu
ThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyGlySer
GlyGlyThrGlnAspCysSerPheGlnHisSerProIleSerSerAspPheAlaValLys
IleArgGluLeuSerAspTyrLeuLeuGlnAspTyrProValThrVal SEQ ID NO:624 hflt3-3435link15.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAlaSerAsnLeuGlnAspGluGluLeuCysGlyGlyLeu
TrpArgLeuValLeuAlaGlnArgTrpMetGluArgLeuLysThrValAlaGlySerLys
MetGlnGlyLeuLeuGluArgValAsnThrGluIleHisPheValThrLysCysAlaPhe
GlnProProProSerCysLeuArgPheValGlnThrAsnIleSerArgLeuLeuGlnGlu
ThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyGlySer
GlyGlyGlySerGlyGlyGlyThrGlnAspCysSerPheGlnHisSerProIleSerSer
AspPheAlaValLysIleArgGluLeuSerAspTyrLeuLeuGlnAspTyrProValThr
Val SEQ ID NO:625

TABLE 3-continued

PROTEIN SEQUENCES hflt3-6263link10.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaValAlaGlySerLysMetGlnGlyLeuLeuGluArgVal
AsnThrGluIleHisPheValThrLysCysAlaPheGlnProProProSerCysLeuArg
PheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAsp
SerSerThrLeuGlyGlyGlySerGlyGlyGlySerGlyGlyThrGlnAspCysSerPhe
GlnHisSerProIleSerSerAspPheAlaValLysIleArgGluLeuSerAspTyrLeu
LeuGlnAspTyrProValThrValAlaSerAsnLeuGlnAspGluGluLeuCysGlyGly
LeuTrpArgLeuValLeuAlaGlnArgTrpMetGluArgLeuLysThr SEQ ID NO:626 hflt3-6263link15.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaValAlaGlySerLysMetGlnGlyLeuLeuGluArgVal
AsnThrGluIleHisPheValThrLysCysAlaPheGlnProProProSerCysLeuArg
PheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAsp
SerSerThrLeuGlyGlyGlySerGlyGlyGlySerGlyGlyGlySerGlyGlyGlyThr
GlnAspCysSerPheGlnHisSerProIleSerSerAspPheAlaValLysIleArgGlu
LeuSerAspTyrLeuLeuGlnAspTyrProValThrValAlaSerAsnLeuGlnAspGlu
GluLeuCysGlyGlyLeuTrpArgLeuValLeuAlaGlnArgTrpMetGluArgLeuLys
Thr SEQ ID NO:627 hflt3-9495link10.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaArgPheValGlnThrAsnIleSerArgLeuLeuGlnGlu
ThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyGlySer
GlyGlyThrGlnAspCysSerPheGlnHisSerProIleSerSerAspPheAlaValLys
IleArgGluLeuSerAspTyrLeuLeuGlnAspTyrProValThrValAlaSerAsnLeu
GlnAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGlu
IleHisPheValThrLysCysAlaPheGlnProProProSerCysLeu SEQ ID NO:628 hflt3-9495link15.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaArgPheValGlnThrAsnIleSerArgLeuLeuGlnGlu
ThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyGlySer
GlyGlyGlySerGlyGlyGlyThrGlnAspCysSerPheGlnHisSerProIleSerSer
AspPheAlaValLysIleArgGluLeuSerAspTyrLeuLeuGlnAspTyrProValThr
ValAlaSerAsnLeuGlnAspGluGluLeuCysGlyGlyLeuTrpArgLeuValLeuAla
GlnArgTrpMetGluArgLeuLysThrValAlaGlySerLysMetGlnGlyLeuLeuGlu
ArgValAsnThrGluIleHisPheValThrLysCysAlaPheGlnProProProSerCys
Leu SEQ ID NO:629

TABLE 3-continued

PROTEIN SEQUENCES hflt3-9899link10.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlySerSer
ProGlyGluProSerGlyProIleSerThrIleAsnProSerProProSerLysGluSer
HisLysSerProAsnMetAlaThrAsnIleSerArgLeuLeuGlnGluThrSerGluGln
LeuValAlaLeuLysProTrpIleThrArgGlnAsnPheSerArgCysLeuGluLeuGln
CysGlnProAspSerSerThrLeuGlyGlyGlySerGlyGlyGlySerGlyGlyThrGln
AspCysSerPheGlnHisSerProIleSerSerAspPheAlaValLysIleArgGluLeu
SerAspTyrLeuLeuGlnAspTyrProValThrValAlaSerAsnLeuGlnAspGluGlu
LeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheVal
ThrLysCysAlaPheGlnProProProSerCysLeuArgPheValGln SEQ ID NO:630 hflt3-9899link15.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaThrAsnIleSerArgLeuLeuGlnGluThrSerGluGln
LeuValAlaLeuLysProTrpIleThrArgGlnAsnPheSerArgCysLeuGluLeuGln
CysGlnProAspSerSerThrLeuGlyGlyGlySerGlyGlyGlySerGlyGlyGlySer
GlyGlyGlyThrGlnAspCysSerPheGlnHisSerProIleSerSerAspPheAlaVal
LysIleArgGluLeuSerAspTyrLeuLeuGlnAspTyrProValThrValAlaSerAsn
LeuGlnAspGluGluLeuCysGlyGlyLeuTrpArgLeuValLeuAlaGlnArgTrpMet
GluArgLeuLysThrValAlaGlySerLysMetGlnGlyLeuLeuGluArgValAsnThr
GluIleHisPheValThrLysCysAlaPheGlnProProProSerCysLeuArgPheVal
Gln SEQ ID NO:631 hflt3-2829link6.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspTyrProValThrValAlaSerAsnLeuGlnAspGlu
GluLeuCysGlyGlyLeuTrpArgLeuValLeuAlaGlnArgTrpMetGluArgLeuLys
ThrValAlaGlySerLysMetGlnGlyLeuLeuGluArgValAsnThrGluIleHisPhe
ValThrLysCysAlaPheGlnProProProSerCysLeuArgPheValGlnThrAsnIle
SerArgLeuLeuGlnGluThrSerGluGlnLeuValAlaLeuLysProTrpIleThrArg
GlnAsnPheSerArgCysLeuGluLeuGlnCysGlnProAspSerSerThrLeuGlyGly
GlySerGlyGlyThrGlnAspCysSerPheGlnHisSerProIleSerSerAspPheAla
ValLysIleArgGluLeuSerAspTyrLeuLeuGln SEQ ID NO:632 hflt3-2829link7.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspTyrProValThrValAlaSerAsnLeuGlnAspGlu
GluLeuCysGlyGlyLeuTrpArgLeuValLeuAlaGlnArgTrpMetGluArgLeuLys
ThrValAlaGlySerLysMetGlnGlyLeuLeuGluArgValAsnThrGluIleHisPhe
ValThrLysCysAlaPheGlnProProProSerCysLeuArgPheValGlnThrAsnIle
SerArgLeuLeuGlnGluThrSerGluGlnLeuValAlaLeuLysProTrpIleThrArg
GlnAsnPheSerArgCysLeuGluLeuGlnCysGlnProAspSerSerThrLeuGlyGly
GlySerGlyGlyGlyThrGlnAspCysSerPheGlnHisSerProIleSerSerAspPhe
AlaValLysIleArgGluLeuSerAspTyrLeuLeuGln SEQ ID NO:633 hflt3-2829link13.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu

TABLE 3-continued

PROTEIN SEQUENCES

ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAspTyrProValThrValAlaSerAsnLeuGlnAspGlu
GluLeuCysGlyGlyLeuTrpArgLeuValLeuAlaGlnArgTrpMetGluArgLeuLys
ThrValAlaGlySerLysMetGlnGlyLeuLeuGluArgValAsnThrGluIleHisPhe
ValThrLysCysAlaPheGlnProProProSerCysLeuArgPheValGlnThrAsnIle
SerArgLeuLeuGlnGluThrSerGluGlnLeuValAlaLeuLysProTrpIleThrArg
GlnAsnPheSerArgCysLeuGluLeuGlnCysGlnProAspSerSerThrLeuGlyGly
GlySerGlyGlyGlySerGlyGlyGlySerGlyThrGlnAspCysSerPheGlnHisSer
ProIleSerSerAspPheAlaValLysIleArgGluLeuSerAspTyrLeuLeuGln
SEQ ID NO:634 hflt3-2829link21.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaValAlaGlySerLysMetGlnGlyLeuLeuGluArgVal
AsnThrGluIleHisPheValThrLysCysAlaPheGlnProProProSerCysLeuArg
PheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAsp
SerSerThrLeuGlyGlyGlySerGlyGlyGlySerGlyGlyGlySerGlyGlyGlySer
GlyGlyGlySerGlyThrGlnAspCysSerPheGlnHisSerProIleSerSerAspPhe
AlaValLysIleArgGluLeuSerAspTyrLeuLeuGlnAspTyrProValThrValAla
SerAsnLeuGlnAspGluGluLeuCysGlyGlyLeuTrpArgLeuValLeuAlaGlnArg
TrpMetGluArgLeuLysThr SEQ ID NO:635 hflt3-3435link6.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAlaSerAsnLeuGlnAspGluGluLeuCysGlyGlyLeu
TrpArgLeuValLeuAlaGlnArgTrpMetGluArgLeuLysThrValAlaGlySerLys
MetGlnGlyLeuLeuGluArgValAsnThrGluIleHisPheValThrLysCysAlaPhe
GlnProProProSerCysLeuArgPheValGlnThrAsnIleSerArgLeuLeuGlnGlu
ThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyThrGln
AspCysSerPheGlnHisSerProIleSerSerAspPheAlaValLysIleArgGluLeu
SerAspTyrLeuLeuGlnAspTyrProValThrVal SEQ ID NO:636 hflt3-3435link7.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAlaSerAsnLeuGlnAspGluGluLeuCysGlyGlyLeu
TrpArgLeuValLeuAlaGlnArgTrpMetGluArgLeuLysThrValAlaGlySerLys
MetGlnGlyLeuLeuGluArgValAsnThrGluIleHisPheValThrLysCysAlaPhe
GlnProProProSerCysLeuArgPheValGlnThrAsnIleSerArgLeuLeuGlnGlu
ThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyGlyThr
GlnAspCysSerPheGlnHisSerProIleSerSerAspPheAlaValLysIleArgGlu
LeuSerAspTyrLeuLeuGlnAspTyrProValThrVal SEQ ID NO:637 hflt3-3435link13.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe

TABLE 3-continued

PROTEIN SEQUENCES

TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAlaSerAsnLeuGlnAspGluGluLeuCysGlyGlyLeu
TrpArgLeuValLeuAlaGlnArgTrpMetGluArgLeuLysThrValAlaGlySerLys
MetGlnGlyLeuLeuGluArgValAsnThrGluIleHisPheValThrLysCysAlaPhe
GlnProProProSerCysLeuArgPheValGlnThrAsnIleSerArgLeuLeuGlnGlu
ThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyGlySer
GlyGlyGlySerGlyThrGlnAspCysSerPheGlnHisSerProIleSerSerAspPhe
AlaValLysIleArgGluLeuSerAspTyrLeuLeuGlnAspTyrProValThrVal
SEQ ID NO:638 hflt3-3435link21.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaAlaSerAsnLeuGlnAspGluGluLeuCysGlyGlyLeu
TrpArgLeuValLeuAlaGlnArgTrpMetGluArgLeuLysThrValAlaGlySerLys
MetGlnGlyLeuLeuGluArgValAsnThrGluIleHisPheValThrLysCysAlaPhe
GlnProProProSerCysLeuArgPheValGlnThrAsnIleSerArgLeuLeuGlnGlu
ThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyGlySer
GlyGlyGlySerGlyGlyGlySerGlyGlyGlySerGlyThrGlnAspCysSerPheGln
HisSerProIleSerSerAspPheAlaValLysIleArgGluLeuSerAspTyrLeuLeu
GlnAspTyrProValThrVal SEQ ID NO:639 hflt3-6263link6.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaValAlaGlySerLysMetGlnGlyLeuLeuGluArgVal
AsnThrGluIleHisPheValThrLysCysAlaPheGlnProProProSerCysLeuArg
PheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAsp
SerSerThrLeuGlyGlyGlySerGlyGlyThrGlnAspCysSerPheGlnHisSerPro
IleSerSerAspPheAlaValLysIleArgGluLeuSerAspTyrLeuLeuGlnAspTyr
ProValThrValAlaSerAsnLeuGlnAspGluGluLeuCysGlyGlyLeuTrpArgLeu
ValLeuAlaGlnArgTrpMetGluArgLeuLysThr SEQ ID NO:640 hflt3-6263link7.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaValAlaGlySerLysMetGlnGlyLeuLeuGluArgVal
AsnThrGluIleHisPheValThrLysCysAlaPheGlnProProProSerCysLeuArg
PheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAsp
SerSerThrLeuGlyGlyGlySerGlyGlyGlyThrGlnAspCysSerPheGlnHisSer
ProIleSerSerAspPheAlaValLysIleArgGluLeuSerAspTyrLeuLeuGlnAsp
TyrProValThrValAlaSerAsnLeuGlnAspGluGluLeuCysGlyGlyLeuTrpArg
LeuValLeuAlaGlnArgTrpMetGluArgLeuLysThr SEQ ID NO:641 hflt3-6263link13.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaValAlaGlySerLysMetGlnGlyLeuLeuGluArgVal

TABLE 3-continued

PROTEIN SEQUENCES

AsnThrGluIleHisPheValThrLysCysAlaPheGlnProProProSerCysLeuArg
PheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAsp
SerSerThrLeuGlyGlyGlySerGlyGlyGlySerGlyGlyGlySerGlyThrGlnAsp
CysSerPheGlnHisSerProIleSerSerAspPheAlaValLysIleArgGluLeuSer
AspTyrLeuLeuGlnAspTyrProValThrValAlaSerAsnLeuGlnAspGluGluLeu
CysGlyGlyLeuTrpArgLeuValLeuAlaGlnArgTrpMetGluArgLeuLysThr
SEQ ID NO:642 hflt3-6263link21.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaValAlaGlySerLysMetGlnGlyLeuLeuGluArgVal
AsnThrGluIleHisPheValThrLysCysAlaPheGlnProProProSerCysLeuArg
PheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAsp
SerSerThrLeuGlyGlyGlySerGlyGlyGlySerGlyGlyGlySerGlyGlySer
GlyGlyGlySerGlyThrGlnAspCysSerPheGlnHisSerProIleSerSerAspPhe
AlaValLysIleArgGluLeuSerAspTyrLeuLeuGlnAspTyrProValThrValAla
SerAsnLeuGlnAspGluGluLeuCysGlyGlyLeuTrpArgLeuValLeuAlaGlnArg
TrpMetGluArgLeuLysThr SEQ ID NO:643 hflt3-9495link6.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaArgPheValGlnThrAsnIleSerArgLeuLeuGlnGlu
ThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyThrGln
AspCysSerPheGlnHisSerProIleSerSerAspPheAlaValLysIleArgGluLeu
SerAspTyrLeuLeuGlnAspTyrProValThrValAlaSerAsnLeuGlnAspGluGlu
LeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheVal
ThrLysCysAlaPheGlnProProProSerCysLeu SEQ ID NO:644 hflt3-9495link7.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaArgPheValGlnThrAsnIleSerArgLeuLeuGlnGlu
ThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyGlyThr
GlnAspCysSerPheGlnHisSerProIleSerSerAspPheAlaValLysIleArgGlu
LeuSerAspTyrLeuLeuGlnAspTyrProValThrValAlaSerAsnLeuGlnAspGlu
GluLeuCysGlyGlyLeuTrpArgLeuValLeuAlaGlnArgTrpMetGluArgLeuLys
ThrValAlaGlySerLysMetGlnGlyLeuLeuGluArgValAsnThrGluIleHisPhe
ValThrLysCysAlaPheGlnProProProSerCysLeu SEQ ID NO:645 hflt3-9495link13.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaArgPheValGlnThrAsnIleSerArgLeuLeuGlnGlu
ThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyGlySer
GlyGlyGlySerGlyThrGlnAspCysSerPheGlnHisSerProIleSerSerAspPhe

TABLE 3-continued

PROTEIN SEQUENCES

AlaValLysIleArgGluLeuSerAspTyrLeuLeuGlnAspTyrProValThrValAla
SerAsnLeuGlnAspGluGluLeuCysGlyGlyLeuTrpArgLeuValLeuAlaGlnArg
TrpMetGluArgLeuLysThrValAlaGlySerLysMetGlnGlyLeuLeuGluArgVal
AsnThrGluIleHisPheValThrLysCysAlaPheGlnProProProSerCysLeu
SEQ ID NO:646 hflt3-9495link21.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlySer
ProGlyGluProSerGlyProIleSerThrIleAsnProSerProProSerLysGluSer
HisLysSerProAsnMetAlaArgPheValGlnThrAsnIleSerArgLeuLeuGlnGlu
ThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyGlySer
GlyGlyGlySerGlyGlyGlySerGlyGlyGlySerGlyThrGlnAspCysSerPheGln
HisSerProIleSerSerAspPheAlaValLysIleArgGluLeuSerAspTyrLeuLeu
GlnAspTyrProValThrValAlaSerAsnLeuGlnAspGluGluLeuCysGlyGlyLeu
TrpArgLeuValLeuAlaGlnArgTrpMetGluArgLeuLysThrValAlaGlySerLys
MetGlnGlyLeuLeuGluArgValAsnThrGluIleHisPheValThrLysCysAlaPhe
GlnProProProSerCysLeu SEQ ID NO:647 hflt3-9899link6.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlySerSer
ProGlyGluProSerGlyProIleSerThrIleAsnProSerProProSerLysGluSer
HisLysSerProAsnMetAlaThrAsnIleSerArgLeuLeuGlnGluThrSerGluGln
LeuValAlaLeuLysProTrpIleThrArgGlnAsnPheSerArgCysLeuGluLeuGln
CysGlnProAspSerSerThrLeuGlyGlyGlySerGlyGlyThrGlnAspCysSerPhe
GlnHisSerProIleSerSerAspPheAlaValLysIleArgGluLeuSerAspTyrLeu
LeuGlnAspTyrProValThrValAlaSerAsnLeuGlnAspGluGluLeuCysGlyGly
LeuTrpArgLeuValLeuAlaGlnArgTrpMetGluArgLeuLysThrValAlaGlySer
LysMetGlnGlyLeuLeuGluArgValAsnThrGluIleHisPheValThrLysCysAla
PheGlnProProProSerCysLeuArgPheValGln SEQ ID NO:648 hflt3-9899link7.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlySerSer
ProGlyGluProSerGlyProIleSerThrIleAsnProSerProProSerLysGluSer
HisLysSerProAsnMetAlaThrAsnIleSerArgLeuLeuGlnGluThrSerGluGln
LeuValAlaLeuLysProTrpIleThrArgGlnAsnPheSerArgCysLeuGluLeuGln
CysGlnProAspSerSerThrLeuGlyGlyGlySerGlyGlyGlyThrGlnAspCysSer
PheGlnHisSerProIleSerSerAspPheAlaValLysIleArgGluLeuSerAspTyr
LeuLeuGlnAspTyrProValThrValAlaSerAsnLeuGlnAspGluGluLeuCysGly
GlyLeuTrpArgLeuValLeuAlaGlnArgTrpMetGluArgLeuLysThrValAlaGly
SerLysMetGlnGlyLeuLeuGluArgValAsnThrGluIleHisPheValThrLysCys
AlaPheGlnProProProSerCysLeuArgPheValGln SEQ ID NO:649 hflt3-9899link13.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlySerSer
ProGlyGluProSerGlyProIleSerThrIleAsnProSerProProSerLysGluSer
HisLysSerProAsnMetAlaThrAsnIleSerArgLeuLeuGlnGluThrSerGluGln
LeuValAlaLeuLysProTrpIleThrArgGlnAsnPheSerArgCysLeuGluLeuGln
CysGlnProAspSerSerThrLeuGlyGlyGlySerGlyGlyGlySerGlyGlyGlySer
GlyThrGlnAspCysSerPheGlnHisSerProIleSerSerAspPheAlaValLysIle
ArgGluLeuSerAspTyrLeuLeuGlnAspTyrProValThrValAlaSerAsnLeuGln
AspGluGluLeuCysGlyGlyLeuTrpArgLeuValLeuAlaGlnArgTrpMetGluArg

TABLE 3-continued

PROTEIN SEQUENCES

LeuLysThrValAlaGlySerLysMetGlnGlyLeuLeuGluArgValAsnThrGluIle
HisPheValThrLysCysAlaPheGlnProProProSerCysLeuArgPheValGln
SEQ ID NO:650 hflt3-9899link21.pep

AlaAsnCysSerIleMetIleAspGluIleIleHisHisLeuLysArgProProAsnPro
LeuLeuAspProAsnAsnLeuAsnSerGluAspMetAspIleLeuMetGluArgAsnLeu
ArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySer
ProGlyGluProSerGlyProIleSerThrIleAsnProSerProProSerLysGluSer
HisLysSerProAsnMetAlaThrAsnIleSerArgLeuLeuGlnGluThrSerGluGln
LeuValAlaLeuLysProTrpIleThrArgGlnAsnPheSerArgCysLeuGluLeuGln
CysGlnProAspSerSerThrLeuGlyGlyGlySerGlyGlyGlySerGlyGlyGlySer
GlyGlyGlySerGlyGlyGlySerGlyThrGlnAspCysSerPheGlnHisSerProIle
SerSerAspPheAlaValLysIleArgGluLeuSerAspTyrLeuLeuGlnAspTyrPro
ValThrValAlaSerAsnLeuGlnAspGluGluLeuCysGlyGlyLeuTrpArgLeuVal
LeuAlaGlnArgTrpMetGluArgLeuLysThrValAlaGlySerLysMetGlnGlyLeu
LeuGluArgValAsnThrGluIleHisPheValThrLysCysAlaPheGlnProProPro
SerCysLeuArgPheValGln SEQ ID NO:651

GlySerThrMetSerArgLeuProValLeuLeuLeuLeuGlnLeuLeuValArgProAlaMetSerThrAsnGln
AspLeuProValIleLysCysValLeuIleAsnHisLysAsnAsnAspSerSerValGlyLysSerSerSerTyr
ProMetValSerGluSerProGluAspLeuGlyCysAlaLeuArgProGlnSerSerGlyThrValTyrGluAla
AlaAlaValGluValAspValSerAlaSerIleThrLeuGlnLeuValLeuAspAlaProGlyAsnIleSerCys
LeuTrpValPheLysHisSerSerLeuAsnCysGlnProHisPheAspLeuGlnAsnArgGlyValValSerMet
ValIleLeuLysMetThrGluThrGlnAlaGlyGluTyrLeuLeuPheIleGlnSerGluAlaThrAsnTyrThr
IleLeuPheThrValSerIleArgAsnThrLeuLeuTyrThrLeuArgArgProTyrPheArgLysMetGluAsn
GlnAspAlaLeuValCysIleSerGluSerValProGluProIleValLeuCysAspSerGlnGly
GluSerCysLysGluGluSerProAlaValValLysLysGluGluLysValLeuHisGluLeuPheGlyMetAsp
IleArgCysCysAlaArgAsnGluLeuGlyArgGluCysThrArgLeuPheThrIleAspLeuAsnGlnThrPro
GlnThrThrLeuProGlnLeuPheLeuLysValGlyGluProLeuTrpIleArgCysLysAlaValHisValAsn
HisGlyPheGlyLeuThrTrpGluLeuGluAsnLysAlaLeuGluValAspAsnTyrPheGluMetSerThrTyr
SerThrAsnArgThrMetIleArgIleLeuPheAlaPheValSerSerValAlaArgAsnAspThrGlyTyrTyr
ThrCysSerSerSerLysHisProSerGlnSerAlaLeuValThrIleValGluLysGlyPheIleAsnAlaThr
AsnSerSerGluAspTyrGluIleAspGlnTyrGluGluPheCysPheSerValArgPheLysAlaTyrProGln
IleArgCysThrTrpThrPheSerArgLysSerPheProCysGluGlnLysGlyLeuAspAsnGlyTyrSerIle
SerLysPheCysAsnHisLysHisGlnProGlyGluTyrIlePheHisAlaGluAsnAspAspAlaGlnPheThr
LysMetPheThrLeuAsnIleArgArgLysProGlnValLeuAlaGluAlaSerAlaSerGlnAlaSerCysPhe
SerAspGlyTyrProLeuProSerTrpThrTrpLysLysCysSerAspLysSerProAsnCysThrGluGluIle
ThrGluGlyValTrpAsnArgLysAlaAsnArgLysValPheGlyGlnTrpValSerSerSerThrLeuAsnMet
SerGluAlaIleLysGlyPheLeuValLysCysCysAlaTyrAsnSerLeuGlyThrSerCysGluThrIleLeu
LeuAsnSerProGlyProPheProPheIleGlnAspAsnGluPheIleIleLeuGlyLeuPheGlyLeuLeuLeu
LeuLeuThrCysLeuCysGlyThrAlaTrpLeuCysCysSerProAsnArgLysAsnProLeuTrpProSerVal
ProAspProAlaHisSerSerLeuGlySerTrpValProThrIleMetGluGluAspAlaPheGlnLeuProGly
LeuGlyThrProProIleThrLysLeuThrValLeuGluGluGlnGlyLysLysProValProTrpGluSerHis
AsnSerSerGluThrCysGlyLeuProThrLeuValGlnThrTyrValLeuGlnGlyAspProArgAlaValSer
ThrGlnProGlnSerGlnSerGlyThrSerAspGlnValLeuTyrGlyGlnLeuLeuGlySerProThrSerPro
GlyProGlyHisTyrLeuArgCysAspSerThrGlnProLeuLeuAlaGlyLeuThrProSerProLysSerTyr
GluAsnLeuTrpPheGlnAlaSerProLeuGlyThrLeuValThrProAlaProSerGlnGluAspAspCysVal
PheGlyProLeuLeuAsnPheProLeuLeuGlnGlyIleArgValHisGlyMetGluAlaLeuGlySerPhe
SEQ ID NO:652 pMON30329.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlySerProGlyGluProSerGlyProIleSerThrIleAsnProSerProProSer
LysGluSerHisLysSerProAsnMetAlaThrGlnAspCysSerPheGlnHisSerProIleSerSerAspPhe
AlaValLysIleArgGluLeuSerAspTyrLeuLeuGlnAspTyrProValThrValAlaSerAsnLeuGlnAsp
GluGluLeuCysGlyGlyLeuTrpArgLeuValLeuAlaGlnArgTrpMetGluArgLeuLysThrValAlaGly
SerLysMetGlnGlyLeuLeuGluArgValAsnThrGluIleHisPheValThrLysCysAlaPheGlnProPro
ProSerCysLeuArgPheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAspSerSerThrLeu
SEQ ID NO:653 pMON32173.pep

AlaThrGlnAspCysSerPheGlnHisSerProIleSerSerAspPheAlaValLysIleArgGluLeuSerAsp
TyrLeuLeuGlnAspTyrProValThrValAlaSerAsnLeuGlnAspGluGluLeuCysGlyGlyLeuTrpArg

TABLE 3-continued

PROTEIN SEQUENCES

LeuValLeuAlaGlnArgTrpMetGluArgLeuLysThrValAlaGlySerLysMetGlnGlyLeuLeuGluArg
ValAsnThrGluIleHisPheValThrLysCysAlaPheGlnProProProSerCysLeuArgPheValGlnThr
AsnIleSerArgLeuLeuGlnGluThrSerGluGlnLeuValAlaLeuLysProTrpIleThrArgGlnAsnPhe
SerArgCysLeuGluLeuGlnCysGlnProAspSerSerThrLeuTyrValGluGlyGlyGlyGlySerProGly
GluProSerGlyProIleSerThrIleAsnProSerProProSerLysGluSerHisLysSerProAsnMetAla
ThrGlnAspCysSerPheGlnHisSerProIleSerSerAspPheAlaValLysIleArgGluLeuSerAspTyr
LeuLeuGlnAspTyrProValThrValAlaSerAsnLeuGlnAspGluGluLeuCysGlyGlyLeuTrpArgLeu
ValLeuAlaGlnArgTrpMetGluArgLeuLysThrValAlaGlySerLysMetGlnGlyLeuLeuGluArgVal
AsnThrGluIleHisPheValThrLysCysAlaPheGlnProProProSerCysLeuArgPheValGlnThrAsn
IleSerArgLeuLeuGlnGluThrSerGluGlnLeuValAlaLeuLysProTrpIleThrArgGlnAsnPheSer
ArgCysLeuGluLeuGlnCysGlnProAspSerSerThrLeu SEQ ID NO:654 pMON32175.pep

AlaThrGlnAspCysSerPheGlnHisSerProIleSerSerAspPheAlaValLysIleArgGluLeuSerAsp
TyrLeuLeuGlnAspTyrProValThrValAlaSerAsnLeuGlnAspGluGluLeuCysGlyGlyLeuTrpArg
LeuValLeuAlaGlnArgTrpMetGluArgLeuLysThrValAlaGlySerLysMetGlnGlyLeuLeuGluArg
ValAsnThrGluIleHisPheValThrLysCysAlaPheGlnProProProSerCysLeuArgPheValGlnThr
AsnIleSerArgLeuLeuGlnGluThrSerGluGlnLeuValAlaLeuLysProTrpIleThrArgGlnAsnPhe
SerArgCysLeuGluLeuGlnCysGlnProAspSerSerThrLeuTyrValGluGlyGlyGlyGlySerProGly
GluProSerGlyProIleSerThrIleAsnProSerProProSerLysGluSerHisLysSerProAsnMetAla
ThrProLeuGlyProAlaSerSerLeuProGlnSerPheLeuLeuLysSerLeuGluGlnValArgLysIleGln
GlyAspGlyAlaAlaLeuGlnGluLysLeuCysAlaThrTyrLysLeuCysHisProGluGluLeuValLeuLeu
GlyHisSerLeuGlyIleProTrpAlaProLeuSerSerCysProSerGlnAlaLeuGlnLeuAlaGlyCysLeu
SerGlnLeuHisSerGlyLeuPheLeuTyrGlnGlyLeuLeuGlnAlaLeuGluGlyIleSerProGluLeuGly
ProThrLeuAspThrLeuGlnLeuAspValAlaAspPheAlaThrThrIleTrpGlnGlnMetGluGluLeuGly
MetAlaProAlaLeuGlnProThrGlnGlyAlaMetProAlaPheAlaSerAlaPheGlnArgArgAlaGlyGly
ValLeuValAlaSerHisLeuGlnSerPheLeuGluValSerTyrArgValLeuArgHisLeuAlaGlnPro
SEQ ID NO:655 pMON32204.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer
LysGluSerHisLysSerProAsnMetAlaThrGlnAspCysSerPheGlnHisSerProIleSerSerAspPhe
AlaValLysIleArgGluLeuSerAspTyrLeuLeuGlnAspTyrProValThrValAlaSerAsnLeuGlnAsp
GluGluLeuCysGlyGlyLeuTrpArgLeuValLeuAlaGlnArgTrpMetGluArgLeuLysThrValAlaGly
SerLysMetGlnGlyLeuLeuGluArgValAsnThrGluIleHisPheValThrLysCysAlaPheGlnProPro
ProSerCysLeuArgPheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAspSerSerThrLeuTyr
ValGluGlyGlyGlyGlySerProGlyGluProSerGlyProIleSerThrIleAsnProSerProProSerLys
GluSerHisLysSerProAsnMetAlaThrGlnAspCysSerPheGlnHisSerProIleSerSerAspPheAla
ValLysIleArgGluLeuSerAspTyrLeuLeuGlnAspTyrProValThrValAlaSerAsnLeuGlnAspGlu
GluLeuCysGlyGlyLeuTrpArgLeuValLeuAlaGlnArgTrpMetGluArgLeuLysThrValAlaGlySer
LysMetGlnGlyLeuLeuGluArgValAsnThrGluIleHisPheValThrLysCysAlaPheGlnProProPro
SerCysLeuArgPheValGlnThrAsnIleSerArgLeuLeuGlnGluThrSerGluGlnLeuValAlaLeuLys
ProTrpIleThrArgGlnAsnPheSerArgCysLeuGluLeuGlnCysGlnProAspSerSerThrLeu SEQ ID NO:656 pMON32205.pep

AlaAsnCysSerIleMetIleAspGluIleIleHisHisLeuLysArgProProAlaProLeuLeuAspProAsn
AsnLeuAsnAspGluAspValSerIleLeuMetAspArgAsnLeuArgLeuProAsnLeuGluSerPheValArg
AlaValLysAsnLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnTyrValGluGlyGlyGlyGlySerProGlyGluProSer
GlyProIleSerThrIleAsnProSerProProSerLysGluSerHisLysSerProAsnMetAlaThrGlnAsp
CysSerPheGlnHisSerProIleSerSerAspPheAlaValLysIleArgGluLeuSerAspTyrLeuLeuGln
AspTyrProValThrValAlaSerAsnLeuGlnAspGluGluLeuCysGlyGlyLeuTrpArgLeuValLeuAla
GlnArgTrpMetGluArgLeuLysThrValAlaGlySerLysMetGlnGlyLeuLeuGluArgValAsnThrGlu
IleHisPheValThrLysCysAlaPheGlnProProProSerCysLeuArgPheValGlnThrAsnIleSerArg
LeuLeuGlnGluThrSerGluGlnLeuValAlaLeuLysProTrpIleThrArgGlnAsnPheSerArgCysLeu
GluLeuGlnCysGlnProAspSerSerThrLeuTyrValGluGlyGlyGlyGlySerProGlyGluProSerGly
ProIleSerThrIleAsnProSerProProSerLysGluSerHisLysSerProAsnMetAlaThrGlnAspCys
SerPheGlnHisSerProIleSerSerAspPheAlaValLysIleArgGluLeuSerAspTyrLeuLeuGlnAsp
TyrProValThrValAlaSerAsnLeuGlnAspGluGluLeuCysGlyGlyLeuTrpArgLeuValLeuAlaGln
ArgTrpMetGluArgLeuLysThrValAlaGlySerLysMetGlnGlyLeuLeuGluArgValAsnThrGluIle
HisPheValThrLysCysAlaPheGlnProProProSerCysLeuArgPheValGlnThrAsnIleSerArgLeu
LeuGlnGluThrSerGluGlnLeuValAlaLeuLysProTrpIleThrArgGlnAsnPheSerArgCysLeuGlu
LeuGlnCysGlnProAspSerSerThrLeu SEQ ID NO:657

TABLE 3-continued

PROTEIN SEQUENCES pMON32208.pep

AlaThrGlnAspCysSerPheGlnHisSerProIleSerSerAspPheAlaValLysIleArgGluLeuSerAsp
TyrLeuLeuGlnAspTyrProValThrValAlaSerAsnLeuGlnAspGluGluLeuCysGlyGlyLeuTrpArg
LeuValLeuAlaGlnArgTrpMetGluArgLeuLysThrValAlaGlySerLysMetGlnGlyLeuLeuGluArg
ValAsnThrGluIleHisPheValThrLysCysAlaPheGlnProProProSerCysLeuArgPheValGlnThr
AsnIleSerArgLeuLeuGlnGluThrSerGluGlnLeuValAlaLeuLysProTrpIleThrArgGlnAsnPhe
SerArgCysLeuGluLeuGlnCysGlnProAspSerSerThrLeuTyrValGluGlyGlyGlyGlySerProGly
GluProSerGlyProIleSerThrIleAsnProSerProProSerLysGluSerHisLysSerProAsnMetAla
ThrProLeuGlyProAlaSerSerLeuProGlnSerPheLeuLeuLysSerLeuGluGlnValArgLysIleGln
GlyAspGlyAlaAlaLeuGlnGluLysLeuCysAlaThrTyrLysLeuCysHisProGluGluLeuValLeuLeu
GlyHisSerLeuGlyIleProTrpAlaProLeuSerSerCysProSerGlnAlaLeuGlnLeuAlaGlyCysLeu
SerGlnLeuHisSerGlyLeuPheLeuTyrGlnGlyLeuLeuGlnAlaLeuGluGlyIleSerProGluLeuGly
ProThrLeuAspThrLeuGlnLeuAspValAlaAspPheAlaThrThrIleTrpGlnGlnMetGluGluLeuGly
MetAlaProAlaLeuGlnProThrGlnGlyAlaMetProAlaPheAlaSerAlaPheGlnArgArgAlaGlyGly
ValLeuValAlaSerHisLeuGlnSerPheLeuGluValSerTyrArgValLeuArgHisLeuAlaGlnProTyr
ValGluGlyGlyGlyGlySerProGlyGluProSerGlyProIleSerThrIleAsnProSerProProSerLys
GluSerHisLysSerProAsnMetAlaThrGlnAspCysSerPheGlnHisSerProIleSerSerAspPheAla
ValLysIleArgGluLeuSerAspTyrLeuLeuGlnAspTyrProValThrValAlaSerAsnLeuGlnAspGlu
GluLeuCysGlyGlyLeuTrpArgLeuValLeuAlaGlnArgTrpMetGluArgLeuLysThrValAlaGlySer
LysMetGlnGlyLeuLeuGluArgValAsnThrGluIleHisPheValThrLysCysAlaPheGlnProProPro
SerCysLeuArgPheValGlnThrAsnIleSerArgLeuLeuGlnGluThrSerGluGlnLeuValAlaLeuLys
ProTrpIleThrArgGlnAsnPheSerArgCysLeuGluLeuGlnCysGlnProAspSerSerThrLeu SEQ ID NO:658 pMON35767.pep/pMON32191.pep

AlaThrGlnAspCysSerPheGlnHisSerProIleSerSerAspPheAlaValLysIleArgGluLeuSerAsp
TyrLeuLeuGlnAspTyrProValThrValAlaSerAsnLeuGlnAspGluGluLeuCysGlyGlyLeuTrpArg
LeuValLeuAlaGlnArgTrpMetGluArgLeuLysThrValAlaGlySerLysMetGlnGlyLeuLeuGluArg
ValAsnThrGluIleHisPheValThrLysCysAlaPheGlnProProProSerCysLeuArgPheValGlnThr
AsnIleSerArgLeuLeuGlnGluThrSerGluGlnLeuValAlaLeuLysProTrpIleThrArgGlnAsnPhe
SerArgCysLeuGluLeuGlnCysGlnProAspSerSerThrLeuTyrValGluGlyGlyGlyGlySerProGly
GlyGlySerGlyGlyGlySerAsnMetAlaThrProLeuGlyProAlaSerSerLeuProGlnSerPheLeuLeu
LysSerLeuGluGlnValArgLysIleGlnGlyAspGlyAlaAlaLeuGlnGluLysLeuCysAlaThrTyrLys
LeuCysHisProGluGluLeuValLeuLeuGlyHisSerLeuGlyIleProTrpAlaProLeuSerSerCysPro
SerGlnAlaLeuGlnLeuAlaGlyCysLeuSerGlnLeuHisSerGlyLeuPheLeuTyrGlnGlyLeuLeuGln
AlaLeuGluGlyIleSerProGluLeuGlyProThrLeuAspThrLeuGlnLeuAspValAlaAspPheAlaThr
ThrIleTrpGlnGlnMetGluGluLeuGlyMetAlaProAlaLeuGlnProThrGlnGlyAlaMetProAlaPhe
AlaSerAlaPheGlnArgArgAlaGlyGlyValLeuValAlaSerHisLeuGlnSerPheLeuGluValSerTyr
ArgValLeuArgHisLeuAlaGlnPro SEQ ID NO:659 pMON32397.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaAspTyrPro
ValThrValAlaSerAsnLeuGlnAspGluGluLeuCysGlyGlyLeuTrpArgLeuValLeuAlaGlnArgTrp
MetGluArgLeuLysThrValAlaGlySerLysMetGlnGlyLeuLeuGluArgValAsnThrGluIleHisPhe
ValThrLysCysAlaPheGlnProProProSerCysLeuArgPheValGlnThrAsnIleSerArgLeuLeuGln
GluThrSerGluGlnLeuValAlaLeuLysProTrpIleThrArgGlnAsnPheSerArgCysLeuGluLeuGln
CysGlnProAspSerSerThrLeuGlyGlyGlySerGlyGlyGlySerGlyGlyThrGlnAspCysSerPheGln
HisSerProIleSerSerAspPheAlaValLysIleArgGluLeuSerAspTyrLeuLeuGln SEQ ID NO:660 pMON32398.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaAspTyrPro
ValThrValAlaSerAsnLeuGlnAspGluGluLeuCysGlyGlyLeuTrpArgLeuValLeuAlaGlnArgTrp
MetGluArgLeuLysThrValAlaGlySerLysMetGlnGlyLeuLeuGluArgValAsnThrGluIleHisPhe
ValThrLysCysAlaPheGlnProProProSerCysLeuArgPheValGlnThrAsnIleSerArgLeuLeuGln
GluThrSerGluGlnLeuValAlaLeuLysProTrpIleThrArgGlnAsnPheSerArgCysLeuGluLeuGln
CysGlnProAspSerSerThrLeuGlyGlyGlySerGlyGlyGlySerGlyGlyGlySerGlyGlyGlyThrGln
AspCysSerPheGlnHisSerProIleSerSerAspPheAlaValLysIleArgGluLeuSerAspTyrLeuLeu
Gln SEQ ID NO:661 pMON32399.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla

TABLE 3-continued

PROTEIN SEQUENCES

ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaAlaSerAsn
LeuGlnAspGluGluLeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheValThrLysCysAlaPhe
GlnProProProSerCysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCysGlnProAspSerSer
ThrLeuGlyGlyGlySerGlyGlyGlySerGlyGlyThrGlnAspCysSerPheGlnHisSerProIleSerSer
AspPheAlaValLysIleArgGluLeuSerAspTyrLeuLeuGlnAspTyrProValThrVal SEQ ID NO:662 pMON35700.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaAlaSerAsn
LeuGlnAspGluGluLeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheValThrLysCysAlaPhe
GlnProProProSerCysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCysGlnProAspSerSer
ThrLeuGlyGlyGlySerGlyGlyGlySerGlyGlyThrGlnAspCysSerPheGlnHis
SerProIleSerSerAspPheAlaValLysIleArgGluLeuSerAspTyrLeuLeuGlnAspTyrProValThr
Val SEQ ID NO:663 pMON35701.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaValAlaGly
SerLysMetGlnGlyLeuLeuGluArgValAsnThrGluIleHisPheValThrLysCysAlaPheGlnProPro
ProSerCysLeuArgPheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAspSerSerThrLeuGly
GlyGlySerGlyGlyGlySerGlyGlyThrGlnAspCysSerPheGlnHisSerProIleSerSerAspPheAla
ValLysIleArgGluLeuSerAspTyrLeuLeuGlnAspTyrProValThrValAlaSerAsnLeuGlnAspGlu
GluLeuCysGlyGlyLeuTrpArgLeuValLeuAlaGlnArgTrpMetGluArgLeuLysThr SEQ ID NO:664 pMON35702.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaValAlaGly
SerLysMetGlnGlyLeuLeuGluArgValAsnThrGluIleHisPheValThrLysCysAlaPheGlnProPro
ProSerCysLeuArgPheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAspSerSerThrLeuGly
GlyGlySerGlyGlyGlySerGlyGlyGlySerGlyGlyGlyThrGlnAspCysSerPheGlnHisSerProIle
SerSerAspPheAlaValLysIleArgGluLeuSerAspTyrLeuLeuGlnAspTyrProValThrValAlaSer
AsnLeuGlnAspGluGluLeuCysGlyGlyLeuTrpArgLeuValLeuAlaGlnArgTrpMetGluArgLeuLys
Thr SEQ ID NO:665 pMON35703.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGlyGlyGlySerProGlyGluProSer
GlyProIleSerThrIleAsnProSerProProSerLysGluSerHisLysSerProAsnMetAlaArgPheVal
GlnThrAsnIleSerArgLeuLeuGlnGluThrSerGluGlnLeuValAlaLeuLysProTrpIleThrArgGln
AsnPheSerArgCysLeuGluLeuGlnCysGlnProAspSerSerThrLeuGlyGlyGlySerGlyGlyGlySer
GlyGlyThrGlnAspCysSerPheGlnHisSerProIleSerSerAspPheAlaValLysIleArgGluLeuSer
AspTyrLeuLeuGlnAspTyrProValThrValAlaSerAsnLeuGlnAspGluGluLeuCysGlyGlyLeuTrp
ArgLeuValLeuAlaGlnArgTrpMetGluArgLeuLysThrValAlaGlySerLysMetGlnGlyLeuLeuGlu
ArgValAsnThrGluIleHisPheValThrLysCysAlaPheGlnProProProSerCysLeu SEQ ID NO:666 pMON35704.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla

TABLE 3-continued

PROTEIN SEQUENCES

ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlySerProGlyGluProSer
GlyProIleSerThrIleAsnProSerProProSerLysGluSerHisLysSerProAsnMetAlaArgPheVal
GlnThrAsnIleSerArgLeuLeuGlnGluThrSerGluGlnLeuValAlaLeuLysProTrpIleThrArgGln
AsnPheSerArgCysLeuGluLeuGlnCysGlnProAspSerSerThrLeuGlyGlyGlySerGlyGlyGlySer
GlyGlyGlySerGlyGlyGlyThrGlnAspCysSerPheGlnHisSerProIleSerSerAspPheAlaValLys
IleArgGluLeuSerAspTyrLeuLeuGlnAspTyrProValThrValAlaSerAsnLeuGlnAspGluGluLeu
CysGlyGlyLeuTrpArgLeuValLeuAlaGlnArgTrpMetGluArgLeuLysThrValAlaGlySerLysMet
GlnGlyLeuLeuGluArgValAsnThrGluIleHisPheValThrLysCysAlaPheGlnProProProSerCys
Leu SEQ ID NO:667 pMON35705.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlySerSerProGlyGluProSer
GlyProIleSerThrIleAsnProSerProProSerLysGluSerHisLysSerProAsnMetAlaThrAsnIle
SerArgLeuLeuGlnGluThrSerGluGlnLeuValAlaLeuLysProTrpIleThrArgGlnAsnPheSerArg
CysLeuGluLeuGlnCysGlnProAspSerSerThrLeuGlyGlySerGlyGlyGlySerGlyGlyGlyThrGln
AspCysSerPheGlnHisSerProIleSerSerAspPheAlaValLysIleArgGluLeuSerAspTyrLeuLeu
GlnAspTyrProValThrValAlaSerAsnLeuGlnAspGluGluLeuCysGlyGlyLeuTrpArgLeuValLeu
AlaGlnArgTrpMetGluArgLeuLysThrValAlaGlySerLysMetGlnGlyLeuLeuGluArgValAsnThr
GluIleHisPheValThrLysCysAlaPheGlnProProProSerCysLeuArgPheValGln SEQ ID NO:668 pMON35706.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaThrAsnIle
SerArgLeuLeuGlnGluThrSerGluGlnLeuValAlaLeuLysProTrpIleThrArgGlnAsnPheSerArg
CysLeuGluLeuGlnCysGlnProAspSerSerThrLeuGlyGlySerGlyGlyGlySerGlyGlyGlySer
GlyGlyGlyThrGlnAspCysSerPheGlnHisSerProIleSerSerAspPheAlaValLysIleArgGluLeu
SerAspTyrLeuLeuGlnAspTyrProValThrValAlaSerAsnLeuGlnAspGluGluLeuCysGlyGlyLeu
TrpArgLeuValLeuAlaGlnArgTrpMetGluArgLeuLysThrValAlaGlySerLysMetGlnGlyLeuLeu
GluArgValAsnThrGluIleHisPheValThrLysCysAlaPheGlnProProProSerCysLeuArgPheVal
Gln SEQ ID NO:669 pMON35733.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaSerAsnLeu
GlnAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAla SEQ ID NO:670 pMON35734.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaAsnLeuGln
AspGluGluLeuCysGlyGlyLeuTrpArgLeuValLeuAlaGlnArgTrpMetGluArgLeuLysThrValAla
GlySerLysMetGlnGlyLeuLeuGluArgValAsnThrGluIleHisPheValThrLysCysAlaPheGlnPro
ProProSerCysLeuArgPheValGlnThrAsnIleSerArgLeuLeuGlnGluThrSerGluGlnLeuValAla
LeuLysProTrpIleThrArgGlnAsnPheSerArgCysLeuGluLeuGlnCysGlnProAspSerSerThrLeu
GlyGlyGlySerGlyGlyGlySerGlyGlyGlySerGlyGlyGlySerGlyGlyGlySerGlyThrGlnAspCys
SerPheGlnHisSerProIleSerSerAspPheAlaValLysIleArgGluLeuSerAspTyrLeuLeuGlnAsp
TyrProValThrValAlaSer SEQ ID NO:671

TABLE 3-continued

PROTEIN SEQUENCES pMON35735.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaLeuGlnAsp
GluGluLeuCysGlyGlyLeuTrpArgLeuValLeuAlaGlnArgTrpMetGluArgLeuLysThrValAlaGly
SerLysMetGlnGlyLeuLeuGluArgValAsnThrGluIleHisPheValThrLysCysAlaPheGlnProPro
ProSerCysLeuArgPheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAspSerSerThrLeuGly
GlyGlySerGlyGlyGlySerGlyGlyGlySerGlyGlyGlySerGlyGlyGlySerGlyThrGlnAspCysSer
PheGlnHisSerProIleSerSerAspPheAlaValLysIleArgGluLeuSerAspTyrLeuLeuGlnAspTyr
ProValThrValAlaSerAsn SEQ ID NO:672 pMON35736.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaGlnAspGlu
GluLeuCysGlyGlyLeuTrpArgLeuValLeuAlaGlnArgTrpMetGluArgLeuLysThrValAlaGlySer
LysMetGlnGlyLeuLeuGluArgValAsnThrGluIleHisPheValThrLysCysAlaPheGlnProProPro
SerCysLeuArgPheValGlnThrAsnIleSerArgLeuLeuGlnGluThrSerGluGlnLeuValAlaLeuLys
ProTrpIleThrArgGlnAsnPheSerArgCysLeuGluLeuGlnCysGlnProAspSerSerThrLeuGlyGly
GlySerGlyGlyGlySerGlyGlyGlySerGlyGlyGlySerGlyGlyGlySerGlyThrGlnAspCysSerPhe
GlnHisSerProIleSerSerAspPheAlaValLysIleArgGluLeuSerAspTyrLeuLeuGlnAspTyrPro
ValThrValAlaSerAsnLeu SEQ ID NO:673 pMON35738.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaGluGluLeu
CysGlyGlyLeuTrpArgLeuValLeuAlaGlnArgTrpMetGluArgLeuLysThrValAlaGlySerLysMet
GlnGlyLeuLeuGluArgValAsnThrGluIleHisPheValThrLysCysAlaPheGlnProProProSerCys
LeuArgPheValGlnThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThrLeuGlyGlyGlySer
GlyGlyGlySerGlyGlyGlySerGlyGlyGlySerGlyGlyGlySerGlyThrGlnAspCysSerPheGlnHis
SerProIleSerSerAspPheAlaValLysIleArgGluLeuSerAspTyrLeuLeuGlnAspTyrProValThr
ValAlaSerAsnLeuGlnAsp SEQ ID NO:674 pMON35739.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaGluLeuCys
GlyGlyLeuTrpArgLeuValLeuAlaGlnArgTrpMetGluArgLeuLysThrValAlaGlySerLysMetGln
GlyLeuLeuGluArgValAsnThrGluIleHisPheValThrLysCysAlaPheGlnProProProSerCysLeu
ArgPheValGlnThrAsnIleSerArgLeuLeuGlnGluThrSerGluGlnLeuValAlaLeuLysProTrpIle
ThrArgGlnAsnPheSerArgCysLeuGluLeuGlnCysGlnProAspSerSerThrLeuGlyGlyGlySerGly
GlyGlySerGlyGlyGlySerGlyGlyGlySerGlyGlyGlySerGlyThrGlnAspCysSerPheGlnHisSer
ProIleSerSerAspPheAlaValLysIleArgGluLeuSerAspTyrLeuLeuGlnAspTyrProValThrVal
AlaSerAsnLeuGlnAspGlu SEQ ID NO:675 pMON35740.pep

AlaAsnCysSerIleMetIleAspGluIleIleHisHisLeuLysArgProProAsnAlaProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaLeuCysSerGly
GlyLeuTrpArgLeuValLeuAlaGlnArgTrpMetGluArgLeuLysThrValAlaGlySerLysMetGlnGly
LeuLeuGluArgValAsnThrGluIleHisPheValThrLysCysAlaPheGlnProProProSerCysLeuArg
PheValGlnThrAsnIleSerArgLeuLeuGlnGluThrSerGluGlnLeuValAlaLeuLysProTrpIleThr
ArgGlnAsnPheSerArgCysLeuGluLeuGlnCysGlnProAspSerSerThrLeuGlyGlyGlySerGlyGly
GlySerGlyGlyGlySerGlyGlyGlySerGlyGlyGlySerGlyThrGlnAspCysSerPheGlnHisSerPro

TABLE 3-continued

PROTEIN SEQUENCES

IleSerSerAspPheAlaValLysIleArgGluLeuSerAspTyrLeuLeuGlnAspTyrProValThrValAla
SerAsnLeuGlnAspGluGlu SEQ ID NO:676 pMON35741.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaSerAsnLeu
GlnAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuArgGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspSerAlaValLysIleArgGluLeuSerAspTyrLeuLeuGln
AspTyrProValThrValAla SEQ ID NO:677 pMON35742.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaGlnAspGlu
GluLeuCysGlyGlyLeuTrpArgLeuValLeuAlaGlnArgTrpMetGluArgLeuLysThrValAlaGlySer
LysMetGlnGlyLeuLeuGluArgValAsnThrGluIleHisPheValThrLysCysAlaPheGlnProProPro
SerCysLeuArgPheValGlnThrAsnIleSerArgLeuLeuArgGluThrSerGluGlnProValAlaLeuLys
ProTrpIleThrArgGlnAsnPheSerArgCysLeuGluLeuGlnCysGlnProAspSerSerThrLeuGlyGly
GlySerGlyGlyGlySerGlyGlyGlySerGlyGlyGlySerGlyGlyGlySerGlyThrGlnAspCysSerPhe
GlnHisSerProIleSerSerAspPheAlaValLysIleArgGluLeuSerAspTyrLeuLeuGlnAspTyrPro
ValThrValAlaSerAsnLeu SEQ ID NO:678 pMON35743.pep

AlaAsnCysSerIleMetIleAspGluIleIleHisHisLeuLysArgProProAsnProLeuLeuAspProAsn
AsnLeuAsnSerGluAspMetAspIleLeuMetGluArgAsnLeuArgThrProAsnLeuLeuAlaPheValArg
AlaValLysHisLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaLeuCysGly
GlyLeuTrpArgLeuValLeuAlaGlnArgTrpMetGluArgLeuLysThrValAlaGlySerLysMetGlnGly
LeuLeuGluArgValAsnThrGluIleHisPheValThrLysCysAlaPheGlnProProProSerCysLeuArg
PheValGlnThrAsnIleSerArgLeuLeuGlnGluThrSerGluGlnLeuValAlaLeuLysProTrpIleThr
ArgGlnAsnPheSerArgCysLeuGluLeuGlnCysArgProAspSerSerThrLeuGlyGlyGlySerGlyGly
GlySerGlyGlyGlySerGlyGlyGlySerGlyGlyGlySerGlyThrGlnAspCysSerPheGlnHisSerPro
IleSerSerAspPheAlaValLysIleArgGluLeuSerAspTyrLeuLeuGlnAspTyrProValThrValAla
SerAsnLeuGlnAspGluGlu SEQ ID NO:679 pMON32179.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuArgGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValTyrValGluGlyGlyGlySerProGlyGluProSerGlyProIleSerThrIleIle
AsnProSerProProSerLysGluSerHisLysSerProAsnMetAlaAsnCysSerIleMetIleAspGluIle
IleHisHisLeuLysArgProProAsnProLeuLeuAspProAsnAsnLeuAsnSerGluAspMetAspIleLeu
MetGluArgAsnLeuArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSerArgHisProIleIle
IleLysAlaGlyAspTrpGlnGluPheArgGluLysLeuThrPheTyrLeuValThrLeuGluGlnAlaGlnGlu
GlnGln SEQ ID NO:680 pMON35707.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuArgProTrpIleThrArgGlnAsnPheSerArgCysLeuGluLeuGlnCysGlnProAspSerSerThr
LeuGlyGlyGlySerGlyGlyGlySerGlyGlyThrGlnAspCysSerPheGlnHisSerProIleSerSerAsp
PheAlaValLysIleArgGluLeuSerAspTyrLeuLeuGlnAspTyrProValThrValAlaSerAsnLeuGln
TyrValGluGlyGlyGlyGlySerProGlyGluProSerGlyProIleSerThrIleAsnProSerProProSer
LysGluSerHisLysSerProAsnMetAlaAsnCysSerIleMetIleAspGluIleIleHisHisLeuLysArg

TABLE 3-continued

PROTEIN SEQUENCES

ProProAsnProLeuLeuAspProAsnAsnLeuAsnSerGluAspMetAspIleLeuMetGluArgAsnLeuArg
ThrProAsnLeuLeuAlaPheValArgAlaValLysHisLeuGluAsnAlaSerGlyIleGluAlaIleLeuArg
AsnLeuGlnProCysLeuProSerAlaThrAlaAlaProSerArgHisProIleIleIleLysAlaGlyAspTrp
GlnGluPheArgGluLysLeuThrPheTyrLeuValThrLeuGluGlnAlaGlnGluGlnGln SEQ ID NO:681 pMON35708.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlyThrGlnAspCysSerPheGlnHisSer
ProIleSerSerAspPheAlaValLysIleArgGluLeuSerAspTyrLeuLeuGlnAspTyrProValThrVal
AlaSerAsnLeuGlnTyrValGluGlyGlyGlySerProGlyGluProSerGlyProIleSerThrIleAsn
ProSerProProSerLysGluSerHisLysSerProAsnMetAlaAsnCysSerIleMetIleAspGluIleIle
HisHisLeuLysArgProProAsnProLeuLeuAspProAsnAsnLeuAsnSerGluAspMetAspIleLeuMet
GluArgAsnLeuArgThrProAsnLeuLeuAlaPheValArgAlaValLysHisLeuGluAsnAlaSerGlyIle
GluAlaIleLeuArgAsnLeuGlnProCysLeuProSerAlaThrAlaAlaProSerArgHisProIleIleIle
LysAlaGlyAspTrpGlnGluPheArgGluLysLeuThrPheTyrLeuValThrLeuGluGlnAlaGlnGluGln
Gln SEQ ID NO:682 pMON35709.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAlaSerAsnLeuGlnTyrValGluGlyGlyGlySerProGlyGluProSerGly
ProIleSerThrIleAsnProSerProProSerLysGluSerHisLysSerProAsnMetAlaAsnCysSerIle
MetIleAspGluIleIleHisHisLeuLysArgProProAsnProLeuLeuAspProAsnAsnLeuAsnSerGlu
AspMetAspIleLeuMetGluArgAsnLeuArgThrProAsnLeuLeuAlaPheValArgAlaValLysHisLeu
GluAsnAlaSerGlyIleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPheTyrLeuValThrLeu
GluGlnAlaGlnGluGlnGln SEQ ID NO:683 pMON35710.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgLeuValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlyThrGlnAspCysSerPheGlnHisSer
ProIleSerSerAspPheAlaValLysIleArgGluLeuSerAspTyrLeuLeuGlnAspTyrProValThrVal
AlaSerAsnLeuGlnTyrValGluGlyGlyGlyGlySerProGlyGluProSerGlyProIleSerThrIleAsn
ProSerProProSerLysGluSerHisLysSerProAsnMetAlaAsnCysSerIleMetIleAspGluIleIle
HisHisLeuLysArgProProAsnProLeuLeuAspProAsnAsnLeuAsnSerGluAspMetAspIleLeuMet
GluArgAsnLeuArgThrProAsnLeuLeuAlaPheValArgAlaValLysHisLeuGluAsnAlaSerGlyIle
GluAlaIleLeuArgAsnLeuGlnProCysLeuProSerAlaThrAlaAlaProSerArgHisProIleIleIle
LysAlaGlyAspTrpGlnGluPheArgGluLysLeuThrPheTyrLeuValThrLeuGluGlnAlaGlnGluGln
Gln SEQ ID NO:684 pMON35711.pep

AlaAspGluGluLeuCysGlyGlyLeuTrpArgLeuValLeuAlaGlnArgTrpMetGlyArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAlaSerAsnLeuGlnTyrValGluGlyGlyGlyGlySerProGlyGluProSerGly
ProIleSerThrIleAsnProSerProProSerLysGluSerHisLysSerProAsnMetAlaAsnCysSerIle
MetIleAspGluIleIleHisHisLeuLysArgProProAsnProLeuLeuAspProAsnAsnLeuAsnSerGlu
AspMetAspIleLeuMetGluArgAsnLeuArgThrProAsnLeuLeuAlaPheValArgAlaValLysHisLeu
GluAsnAlaSerGlyIleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPheTyrLeuValThrLeu
GluGlnAlaGlnGluGlnGln SEQ ID NO:685 pMON35719.pep

MetAlaAspTyrProValThrValAlaSerAsnLeuGlnAspGluGluLeuCysGlyGlyLeuTrpArgLeuVal
LeuAlaGlnArgTrpMetGluArgLeuLysThrValAlaGlySerLysMetGlnGlyLeuLeuGluArgValAsn
ThrGluIleHisPheValThrLysCysAlaPheGlnProProProSerCysLeuArgPheValGlnThrAsnIle
SerArgLeuLeuGlnGluThrSerGluGlnLeuValAlaLeuLysProTrpIleThrArgGlnAsnPheSerArg
CysLeuGluLeuGlnCysGlnProAspSerSerThrLeuGlyGlyGlySerGlyGlyGlySerGlyGlyGlySer
GlyGlyGlyThrGlnAspCysSerPheGlnHisSerProIleSerSerAspPheAlaValLysIleArgGluLeu

TABLE 3-continued

PROTEIN SEQUENCES

SerAspTyrLeuLeuGlnTyrValGluGlyGlyGlySerProGlyGluProSerGlyProIleSerThrIle
AsnProSerProProSerLysGluSerHisLysSerProAsnMetAlaAsnCysSerIleMetIleAspGluIle
IleHisHisLeuLysArgProProAsnProLeuLeuAspProAsnAsnLeuAsnSerGluAspMetAspIleLeu
MetGluArgAsnLeuArgThrProAsnLeuLeuAlaPheValArgAlaValLysHisLeuGluAsnAlaSerGly
IleGluAlaIleLeuArgAsnLeuGlnProCysLeuProSerAlaThrAlaAlaProSerArgHisProIleIle
IleLysAlaGlyAspTrpGlnGluPheArgGluLysLeuThrPheTyrLeuValThrLeuGluGlnAlaGlnGlu
GlnGln SEQ ID NO:686 pMON35720.pep

AlaAlaSerAsnLeuGlnAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGluIleHisPheValThr
LysCysAlaPheGlnProProProSerCysLeuArgPheValGlnThrAsnIleSerArgLeuLeuGlnGluThr
SerGluGlnLeuValAlaLeuLysProTrpIleThrArgGlnAsnPheSerArgCysLeuGluLeuGlnCysGln
ProAspSerSerThrLeuGlyGlyGlySerGlyGlyGlySerGlyGlyGlySerGlyGlyGlyThrGlnAspCys
SerPheGlnHisSerProIleSerSerAspPheAlaValLysIleArgGluLeuSerAspTyrLeuLeuGlnAsp
TyrProValThrValTyrValGluGlyGlyGlySerProGlyGluProSerGlyProIleSerThrIleAsn
ProSerProProSerLysGluSerHisLysSerProAsnMetAlaAsnCysSerIleMetIleAspGluIleIle
HisHisLeuLysArgProProAsnProLeuLeuAspProAsnAsnLeuAsnSerGluAspMetAspIleLeuMet
GluArgAsnLeuArgThrProAsnLeuLeuAlaPheValArgAlaValLysHisLeuGluAsnAlaSerGlyIle
GluAlaIleLeuArgAsnLeuGlnProCysLeuProSerAlaThrAlaAlaProSerArgHisProIleIleIle
LysAlaGlyAspTrpGlnGluPheArgGluLysLeuThrPheTyrLeuValThrLeuGluGlnAlaGlnGluGln
Gln SEQ ID NO:687 pMON35721.pep

AlaValAlaGlySerLysMetGlnGlyLeuLeuGluArgValAsnThrGluIleHisPheValThrLysCysAla
PheGlnProProProSerCysLeuArgPheValGlnThrAsnIleSerArgLeuLeuGlnGluThrSerGluGln
LeuValAlaLeuLysProTrpIleThrArgGlnAsnPheSerArgCysLeuGluLeuGlnCysGlnProAspSer
SerThrLeuGlyGlyGlySerGlyGlyGlySerGlyGlyGlySerGlyGlyGlyThrGlnAspCysSerPheGln
HisSerProIleSerSerAspPheAlaValLysIleArgGluLeuSerAspTyrLeuLeuGlnAspTyrProVal
ThrValAlaSerAsnLeuGlnAspGluGluLeuCysGlyGlyLeuTrpArgLeuValLeuAlaGlnArgTrpMet
GluArgLeuLysThrTyrValGluGlyGlyGlySerProGlyGluProSerGlyProIleSerThrIleAsn
ProSerProProSerLysGluSerHisLysSerProAsnMetAlaAsnCysSerIleMetIleAspGluIleIle
HisHisLeuLysArgProProAsnProLeuLeuAspProAsnAsnLeuAsnSerGluAspMetAspIleLeuMet
GluArgAsnLeuArgThrProAsnLeuLeuAlaPheValArgAlaValLysHisLeuGluAsnAlaSerGlyIle
GluAlaIleLeuArgAsnLeuGlnProCysLeuProSerAlaThrAlaAlaProSerArgHisProIleIleIle
LysAlaGlyAspTrpGlnGluPheArgGluLysLeuThrPheTyrLeuValThrLeuGluGlnAlaGlnGluGln
Gln SEQ ID NO:688 pMON35722.pep

AlaSerLysMetGlnGlyLeuLeuGluArgValAsnThrGluIleHisPheValThrLysCysAlaPheGlnPro
ProProSerCysLeuArgPheValGlnThrAsnIleSerArgLeuLeuGlnGluThrSerGluGlnLeuValAla
LeuLysProTrpIleThrArgGlnAsnPheSerArgCysLeuGluLeuGlnCysGlnProAspSerSerThrLeu
GlyGlyGlySerGlyGlyGlySerGlyGlyGlySerGlyGlyGlyThrGlnAspCysSerPheGlnHisSerPro
IleSerSerAspPheAlaValLysIleArgGluLeuSerAspTyrLeuLeuGlnAspTyrProValThrValAla
SerAsnLeuGlnAspGluGluLeuCysGlyGlyLeuTrpArgLeuValLeuAlaGlnArgTrpMetGluArgLeu
LysThrValAlaGlyTyrValGluGlyGlyGlySerProGlyGluProSerGlyProIleSerThrIleAsn
ProSerProProSerLysGluSerHisLysSerProAsnMetAlaAsnCysSerIleMetIleAspGluIleIle
HisHisLeuLysArgProProAsnProLeuLeuAspProAsnAsnLeuAsnSerGluAspMetAspIleLeuMet
GluArgAsnLeuArgThrProAsnLeuLeuAlaPheValArgAlaValLysHisLeuGluAsnAlaSerGlyIle
GluAlaIleLeuArgAsnLeuGlnProCysLeuProSerAlaThrAlaAlaProSerArgHisProIleIleIle
LysAlaGlyAspTrpGlnGluPheArgGluLysLeuThrPheTyrLeuValThrLeuGluGlnAlaGlnGluGln
Gln SEQ ID NO:689 pMON35723.pep

AlaProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlyThrGlnAspCysSerPheGlnHisSer
ProIleSerSerAspPheAlaValLysIleArgGluLeuSerAspTyrLeuLeuGlnAspTyrProValThrVal
AlaSerAsnLeuGlnAspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIleHisPheValThrLys
CysAlaPheGlnProTyrValGluGlyGlyGlySerProGlyGluProSerGlyProIleSerThrIleAsn
ProSerProProSerLysGluSerHisLysSerProAsnMetAlaAsnCysSerIleMetIleAspGluIleIle
HisHisLeuLysArgProProAsnProLeuLeuAspProAsnAsnLeuAsnSerGluAspMetAspIleLeuMet
GluArgAsnLeuArgThrProAsnLeuLeuAlaPheValArgAlaValLysHisLeuGluAsnAlaSerGlyIle
GluAlaIleLeuArgAsnLeuGlnProCysLeuProSerAlaThrAlaAlaProSerArgHisProIleIleIle
LysAlaGlyAspTrpGlnGluPheArgGluLysLeuThrPheTyrLeuValThrLeuGluGlnAlaGlnGluGln
Gln SEQ ID NO:690 pMON35725.pep

AlaThrAsnIleSerArgLeuLeuGlnGluThrSerGluGlnLeuValAlaLeuLysProTrpIleThrArgGln
AsnPheSerArgCysLeuGluLeuGlnCysGlnProAspSerSerThrLeuGlyGlyGlySerGlyGlyGlySer
GlyGlyGlySerGlyGlyGlyThrGlnAspCysSerPheGlnHisSerProIleSerSerAspPheAlaValLys

TABLE 3-continued

PROTEIN SEQUENCES

IleArgGluLeuSerAspTyrLeuLeuGlnAspTyrProValThrValAlaSerAsnLeuGlnAspGluGluLeu
CysGlyGlyLeuTrpArgLeuValLeuAlaGlnArgTrpMetGluArgLeuLysThrValAlaGlySerLysMet
GlnGlyLeuLeuGluArgValAsnThrGluIleHisPheValThrLysCysAlaPheGlnProProProSerCys
LeuArgPheValGlnTyrValGluGlyGlyGlyGlySerProGlyGluProSerGlyProIleSerThrIleAsn
ProSerProProSerLysGluSerHisLysSerProAsnMetAlaAsnCysSerIleMetIleAspGluIleIle
HisHisLeuLysArgProProAsnProLeuLeuAspProAsnAsnLeuAsnSerGluAspMetAspIleLeuMet
GluArgAsnLeuArgThrProAsnLeuLeuAlaPheValArgAlaValLysHisLeuGluAsnAlaSerGlyIle
GluAlaIleLeuArgAsnLeuGlnProCysLeuProSerAlaThrAlaAlaProSerArgHisProIleIleIle
LysAlaGlyAspTrpGlnGluPheArgGluLysLeuThrPheTyrLeuValThrLeuGluGlnAlaGlnGluGln
Gln SEQ ID NO:691 pMON35726.pep

AlaArgPheValGlnThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThrLeuGlyGlyGlySer
GlyGlyGlySerGlyGlyGlySerGlyGlyGlyThrGlnAspCysSerPheGlnHisSerProIleSerSerAsp
PheAlaValLysIleArgGluLeuSerAspTyrLeuLeuGlnAspTyrProValThrValAlaSerAsnLeuGln
AspGluGluLeuCysGlyGlyLeuTrpArgLeuValLeuAlaGlnArgTrpMetGluArgLeuLysThrValAla
GlySerLysMetGlnGlyLeuLeuGluArgValAsnThrGluIleHisPheValThrLysCysAlaPheGlnPro
ProProSerCysPheTyrValGluGlyGlyGlyGlySerProGlyGluProSerGlyProIleSerThrIleAsn
ProSerProProSerLysGluSerHisLysSerProAsnMetAlaAsnCysSerIleMetIleAspGluIleIle
HisHisLeuLysArgProProAsnProLeuLeuAspProAsnAsnLeuAsnSerGluAspMetAspIleLeuMet
GluArgAsnLeuArgThrProAsnLeuLeuAlaPheValArgAlaValLysHisLeuGluAsnAlaSerGlyIle
GluAlaIleLeuArgAsnLeuGlnProCysLeuProSerAlaThrAlaAlaProSerArgHisProIleIleIle
LysAlaGlyAspTrpGlnGluPheArgGluLysLeuThrPheTyrLeuValThrLeuGluGlnAlaGlnGluGln
Gln SEQ ID NO:692 pMON35744.pep

AlaSerAsnLeuGlnAspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIleHisPheValThrLys
CysAlaPheGlnProProProSerCysLeuArgPheValGlnThrAsnIleSerArgLeuLeuGlnGluThrSer
GluGlnLeuValAlaLeuLysProTrpIleThrArgGlnAsnPheSerArgCysLeuGluLeuGlnCysGlnPro
AspSerSerThrLeuGlyGlyGlySerGlyGlyGlySerGlyGlyGlySerGlyGlyGlySerGlyGlyGlySer
GlyThrGlnAspCysSerPheGlnHisSerProIleSerSerAspPheAlaValLysIleArgGluLeuSerAsp
TyrLeuLeuGlnAspTyrProValThrValAlaTyrValGluGlyGlyGlyGlySerProGlyGluProSerGly
ProIleSerThrIleAsnProSerProProSerLysGluSerHisLysSerProAsnMetAlaAsnCysSerIle
MetIleAspGluIleIleHisHisLeuLysArgProProAsnProLeuLeuAspProAsnAsnLeuAsnSerGlu
AspMetAspIleLeuMetGluArgAsnLeuArgThrProAsnLeuLeuAlaPheValArgAlaValLysHisLeu
GluAsnAlaSerGlyIleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPheTyrLeuValThrLeu
GluGlnAlaGlnGluGlnGln SEQ ID NO:693 pMON35745.pep

AlaAsnLeuGlnAspGluGluLeuCysGlyGlyLeuTrpArgLeuValLeuAlaGlnArgTrpMetGluArgLeu
LysThrValAlaGlySerLysMetGlnGlyLeuLeuGluArgValAsnThrGluIleHisPheValThrLysCys
AlaPheGlnProProProSerCysLeuArgPheValGlnThrAsnIleSerArgLeuLeuGlnGluThrSerGlu
GlnLeuValAlaLeuLysProTrpIleThrArgGlnAsnPheSerArgCysLeuGluLeuGlnCysGlnProAsp
SerSerThrLeuGlyGlyGlySerGlyGlyGlySerGlyGlyGlySerGlyGlyGlySerGlyGlyGlySerGly
ThrGlnAspCysSerPheGlnHisSerProIleSerSerAspPheAlaValLysIleArgGluLeuSerAspTyr
LeuLeuGlnAspTyrProValThrValAlaSerTyrValGluGlyGlyGlyGlySerProGlyGluProSerGly
ProIleSerThrIleAsnProSerProProSerLysGluSerHisLysSerProAsnMetAlaAsnCysSerIle
MetIleAspGluIleIleHisHisLeuLysArgProProAsnProLeuLeuAspProAsnAsnLeuAsnSerGlu
AspMetAspIleLeuMetGluArgAsnLeuArgThrProAsnLeuLeuAlaPheValArgAlaValLysHisLeu
GluAsnAlaSerGlyIleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPheTyrLeuValThrLeu
GluGlnAlaGlnGluGlnGln SEQ ID NO:694 pMON35746.pep

AlaLeuGlnAspGluGluLeuCysGlyGlyLeuTrpArgLeuValLeuAlaGlnArgLeuMetGluArgLeuLys
ThrValAlaGlySerLysMetGlnGlyLeuLeuGluArgValAsnThrGluIleHisPheValThrLysCysAla
PheGlnProProProSerCysLeuArgPheValGlnThrAsnIleSerArgLeuLeuGlnGluThrSerGluGln
LeuValAlaLeuLysProTrpIleThrArgGlnAsnPheSerArgCysLeuGluLeuGlnCysGlnProAspSer
SerThrLeuGlyGlyGlySerGlyGlyGlySerGlyGlyGlySerGlyGlyGlySerGlyGlyGlySerGlyThr
GlnAspCysSerPheGlnHisSerProIleSerSerAspPheAlaValLysIleArgGluLeuSerAspTyrLeu
LeuGlnAspTyrProValThrValAlaSerAsnTyrValGluGlyGlyGlyGlySerProGlyGluProSerGly
ProIleSerThrIleAsnProSerProProSerLysGluSerHisLysSerProAsnMetAlaAsnCysSerIle
MetIleAspGluIleIleHisHisLeuLysArgProProAsnProLeuLeuAspProAsnAsnLeuAsnSerGlu
AspMetAspIleLeuMetGluArgAsnLeuArgThrProAsnLeuLeuAlaPheValArgAlaValLysHisLeu
GluAsnAlaSerGlyIleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPheTyrLeuValThrLeu
GluGlnAlaGlnGluGlnGln SEQ ID NO:695

TABLE 3-continued

PROTEIN SEQUENCES pMON35747.pep

AlaGlnAspGluGluLeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheValThrLysCysAlaPhe
GlnProProProSerCysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCysGlnProAspSerSer
ThrLeuGlyGlyGlySerGlyGlyGlySerGlyGlyGlySerGlyGlyGlySerGlyThrGln
AspCysSerPheGlnHisSerProIleSerSerAspPheAlaValLysIleArgGluLeuSerAspTyrLeuLeu
GlnAspTyrProValThrValAlaSerAsnLeuTyrValGluGlyGlyGlyGlySerProGlyGluProSerGly
ProIleSerThrIleAsnProSerProProSerLysGluSerHisLysSerProAsnMetAlaAsnCysSerIle
MetIleAspGluIleIleHisHisLeuLysArgProProAsnProLeuLeuAspProAsnAsnLeuAsnSerGlu
AspMetAspIleLeuMetGluArgAsnLeuArgThrProAsnLeuLeuAlaPheValArgAlaValLysHisLeu
GluAsnAlaSerGlyIleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPheTyrLeuValThrLeu
GluGlnAlaGlnGluGlnGln SEQ ID NO:696 pMON35748.pep

AlaGluGluLeuCysGlyGlyLeuTrpArgLeuValLeuAlaGlnArgTrpMetGluArgLeuLysThrValAla
GlySerLysMetGlnGlyLeuLeuGluArgValAsnThrGluIleHisPheValThrLysCysAlaPheGlnPro
ProProSerCysLeuArgPheValGlnThrAsnIleSerArgLeuLeuGlnGluThrSerGluGlnLeuValAla
LeuLysProTrpIleThrArgGlnAsnPheSerArgCysLeuGluLeuGlnCysGlnProAspSerSerThrLeu
GlyGlyGlySerGlyGlyGlySerGlyGlyGlySerGlyGlyGlySerGlyThrGlnAspCys
SerPheGlnHisSerProIleSerSerAspPheAlaValLysIleArgGluLeuSerAspTyrLeuLeuGlnAsp
TyrProValThrValAlaSerAsnLeuGlnAspTyrValGluGlyGlyGlyGlySerProGlyGluProSerGly
ProIleSerThrIleAsnProSerProProSerLysGluSerHisLysSerProAsnMetAlaAsnCysSerIle
MetIleAspGluIleIleHisHisLeuLysArgProProAsnProLeuLeuAspProAsnAsnLeuAsnSerGlu
AspMetAspIleLeuMetGluArgAsnLeuArgThrProAsnLeuLeuAlaPheValArgAlaValLysHisLeu
GluAsnAlaSerGlyIleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPheTyrLeuValThrLeu
GluGlnAlaGlnGluGlnGln SEQ ID NO:697 pMON35749.pep

AlaLeuCysGlyGlyLeuTrpArgLeuValLeuAlaGlnArgTrpMetGluArgLeuLysThrValAlaGlySer
LysMetGlnGlyLeuLeuGluArgValAsnThrGluIleHisPheValThrLysCysAlaPheGlnProProPro
SerCysLeuArgPheValGlnThrAsnIleSerArgLeuLeuGlnGluThrSerGluGlnLeuValAlaLeuLys
ProTrpIleThrArgGlnAsnPheSerArgCysLeuGluLeuGlnCysGlnProAspSerSerThrLeuGlyGly
GlySerGlyGlyGlySerGlyGlyGlySerGlyGlyGlySerGlyThrGlnAspCysSerPhe
GlnHisSerProIleSerSerAspPheAlaValLysIleArgGluLeuSerAspTyrLeuLeuGlnAspTyrPro
ValThrValAlaSerAsnLeuGlnAspGluGluTyrValGluGlyGlyGlyGlySerProGlyGluProSerGly
ProIleSerThrIleAsnProSerProProSerLysGluSerHisLysSerProAsnMetAlaAsnCysSerIle
MetIleAspGluIleIleHisHisLeuLysArgProProAsnProLeuLeuAspProAsnAsnLeuAsnSerGlu
AspMetAspIleLeuMetGluArgAsnLeuArgThrProAsnLeuLeuAlaPheValArgAlaValLysHisLeu
GluAsnAlaSerGlyIleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPheTyrLeuValThrLeu
GluGlnAlaGlnGluGlnGln SEQ ID NO:698 pMON35750.pep

AlaLeuCysGlyGlyLeuTrpArgLeuValLeuAlaGlnArgTrpMetGluArgLeuLysThrValAlaGlySer
LysMetGlnGlyLeuLeuGluArgValAsnThrGluIleHisPheValThrLysCysAlaPheGlnProProPro
SerCysLeuArgPheValGlnThrAsnIleSerArgLeuLeuGlnGluThrSerGluGlnLeuValAlaLeuLys
ProTrpIleThrArgGlnAsnPheSerArgCysLeuGluLeuGlnCysGlnProAspSerSerThrLeuGlyGly
GlySerGlyGlyGlySerGlyGlyGlySerGlyGlyGlySerGlyThrGlnAspCysSerPhe
GlnHisSerProIleSerSerAspPheAlaValLysIleArgGluLeuSerAspTyrLeuLeuGlnAspTyrPro
ValThrValAlaSerAsnLeuGlnAspGluGluTyrValGluGlyGlyGlyGlySerProGlyGluProSerGly
ProIleSerThrIleAsnProSerProProSerLysGluSerHisLysSerProAsnMetAlaAsnCysSerIle
MetIleAspGluIleIleHisHisLeuLysArgProProAsnProLeuLeuAspProAsnAsnLeuAsnSerGlu
AspMetAspIleLeuMetGluArgAsnLeuArgThrProAsnLeuLeuAlaPheValArgAlaValLysHisLeu
GluAsnAlaSerGlyIleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPheTyrLeuValThrLeu
GluGlnAlaGlnGluGlnGln SEQ ID NO:699 pMON35769.pep

AlaLeuCysGlyGlyLeuTrpArgLeuValLeuAlaGlnArgTrpMetGluArgLeuLysThrValAlaGlySer
LysMetGlnGlyLeuLeuGluArgValAsnThrGluIleHisPheValThrLysCysAlaPheGlnProProPro
SerCysLeuArgPheValGlnThrAsnIleSerArgLeuLeuGlnGluThrSerGluGlnLeuValAlaLeuLys
ProTrpIleThrArgGlnAsnPheSerArgCysLeuGluLeuGlnCysArgProAspSerSerThrLeuGlyGly
GlySerGlyGlyGlySerGlyGlyGlySerGlyGlyGlySerGlyThrGlnAspCysSerPhe
GlnHisSerProIleSerSerAspPheAlaValLysIleArgGluLeuSerAspTyrLeuLeuGlnAspTyrPro
ValThrValAlaSerAsnLeuGlnAspGluGluTyrValGluGlyGlyGlyGlySerProGlyGluProSerGly
ProIleSerThrIleAsnProSerProProSerLysGluSerHisLysSerProAsnMetAlaAsnCysSerIle
MetIleAspGluIleIleHisHisLeuLysArgProProAsnProLeuLeuAspProAsnAsnLeuAsnSerGlu
AspMetAspIleLeuMetGluArgAsnLeuArgThrProAsnLeuLeuAlaPheValArgAlaValLysHisLeu
GluAsnAlaSerGlyIleGluAlaIleLeuArgAsnLeuGlnProCysLeuProSerAlaThrAlaAlaProSer

TABLE 3-continued

PROTEIN SEQUENCES

ArgHisProIleIleIleLysAlaGlyAspTrpGlnGluPheArgGluLysLeuThrPheTyrLeuValThrLeu
GluGlnAlaGlnGluGlnGln SEQ ID NO:700 pMON35771.pep

AlaSerLysMetGlnGlyLeuLeuGluArgValAsnThrGluIleHisPheValThrLysCysAlaPheGlnPro
ProProSerCysLeuArgPheValGlnThrAsnIleSerArgLeuLeuGlnGluThrSerGluGlnLeuValAla
LeuLysProTrpIleThrArgGlnAsnPheSerArgCysLeuGluLeuGlnCysGlnProAspSerSerThrLeu
GlyGlyGlySerGlyGlyGlySerGlyGlyGlySerGlyGlyGlyThrGlnAspCysSerPheGlnHisSerPro
IleSerSerAspPheAlaValLysIleArgGluLeuSerAspTyrLeuLeuGlnAspTyrProValThrValAla
SerAsnLeuGlnAspGluGluLeuCysGlyGlyLeuTrpArgLeuValLeuAlaGlnArgTrpMetGluArgLeu
LysThrValAlaGlyTyrValGluGlyGlyGlyGlySerProGlyGluProSerGlyProIleSerThrIleAsn
ProSerProProSerLysGluSerHisLysSerProAsnMetAlaAsnCysSerIleMetIleAspGluIleIle
HisHisLeuLysArgProProAsnProLeuLeuAspProAsnAsnLeuAsnSerGluAspMetAspIleLeuMet
GluArgAsnLeuArgThrProAsnLeuLeuAlaPheValArgAlaValLysHisLeuGluAsnAlaSerGlyIle
GluAlaIleLeuArgAsnLeuGlnProCysLeuProSerAlaThrAlaAlaProSerArgHisProIleIleIle
LysAlaGlyAspTrpGlnGluPheArgGluLysLeuThrPheTyrLeuValThrLeuGluGlnAlaGlnGluGln
Gln SEQ ID NO:701 pMON35774.pep

AlaGlnAspAspGluLeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheValThrLysCysAlaPhe
GlnProProProSerCysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCysGlnProAspSerSer
ThrLeuGlyGlyGlySerGlyGlyGlySerGlyGlyGlySerGlyGlyGlySerGlyGlyGlySerGlyGlyGly
SerGlyGlyGlySerGlyThrGlnAspCysSerPheGlnHisSerProIleSerSerAspPheAlaValLysIle
ArgGluLeuSerAspTyrLeuLeuGlnAspTyrProValThrValAlaSerAsnLeuTyrValGluGlyGlyGly
GlySerProGlyGluProSerGlyProIleSerThrIleAsnProSerProProSerLysGluSerHisLysSer
ProAsnMetAlaAsnCysSerIleMetIleAspGluIleIleHisHisLeuLysArgProProAsnProLeuLeu
AspProAsnAsnLeuAsnSerGluAspMetAspIleLeuMetGluArgAsnLeuArgThrProAsnLeuLeuAla
PheValArgAlaValLysHisLeuGluAsnAlaSerGlyIleGluAlaIleLeuArgAsnLeuGlnProCysLeu
ProSerAlaThrAlaAlaProSerArgHisProIleIleIleLysAlaGlyAspTrpGlnGluPheArgGluLys
LeuThrPheTyrLeuValThrLeuGluGlnAlaGlnGluGlnGln SEQ ID NO:702 pMON35775.pep

AlaGlnAspGluGluLeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheValThrLysCysAlaPhe
GlnProProProSerCysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCysGlnProAspSerSer
ThrLeuProProProTrpSerProArgProLeuGlyAlaThrAlaProThrThrGlnAspCysSerPheGlnHis
SerProIleSerSerAspPheAlaValLysIleArgGluLeuSerAspTyrLeuLeuGlnAspTyrProValThr
ValAlaSerAsnLeuTyrValGluGlyGlyGlyGlySerProGlyGluProSerGlyProIleSerThrIleAsn
ProSerProProSerLysGluSerHisLysSerProAsnMetAlaAsnCysSerIleMetIleAspGluIleIle
HisHisLeuLysArgProProAsnProLeuLeuAspProAsnAsnLeuAsnSerGluAspMetAspIleLeuMet
GluArgAsnLeuArgThrProAsnLeuLeuAlaPheValArgAlaValLysHisLeuGluAsnAlaSerGlyIle
GluAlaIleLeuArgAsnLeuGlnProCysLeuProSerAlaThrAlaAlaProSerArgHisProIleIleIle
LysAlaGlyAspTrpGlnGluPheArgGluLysLeuThrPheTyrLeuValThrLeuGluGlnAlaGlnGluGln
Gln SEQ ID NO:703 pMON35776.pep

AlaGlnAspGluGluLeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheValThrLysCysAlaPhe
GlnProProProSerCysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCysGlnProAspSerSer
ThrLeuProProProTrpSerProArgProLeuGlyAlaThrAlaProThrAlaGlyGlnProProLeuThrGln
AspCysSerPheGlnHisSerProIleSerSerAspPheAlaValLysIleArgGluLeuSerAspTyrLeuLeu
GlnAspTyrProValThrValAlaSerAsnLeuTyrValGluGlyGlyGlyGlySerProGlyGluProSerGly
ProIleSerThrIleAsnProSerProProSerLysGluSerHisLysSerProAsnMetAlaAsnCysSerIle
MetIleAspGluIleIleHisHisLeuLysArgProProAsnProLeuLeuAspProAsnAsnLeuAsnSerGlu
AspMetAspIleLeuMetGluArgAsnLeuArgThrProAsnLeuLeuAlaPheValArgAlaValLysHisLeu
GluAsnAlaSerGlyIleGluAlaIleLeuArgAsnLeuGlnProCysLeuProSerAlaThrAlaAlaProSer
ArgHisProIleIleIleLysAlaGlyAspTrpGlnGluPheArgGluLysLeuThrPheTyrLeuValThrLeu
GluGlnAlaGlnGluGlnGln SEQ ID NO:704 pMON32169.pep/pMON40000.pep

AlaThrProLeuGlyProAlaSerSerLeuProGlnSerPheLeuLeuLysSerLeuGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer

TABLE 3-continued

PROTEIN SEQUENCES

LysGluSerHisLysSerProAsnMetAlaAspGluGluLeuCysGlyGlyLeuTrpArgLeuValLeuAlaGln
ArgTrpMetGluArgLeuLysThrValAlaGlySerLysMetGlnGlyLeuLeuGluArgValAsnThrGluIle
HisPheValThrLysCysAlaPheGlnProProProSerCysLeuArgPheValGlnThrAsnIleSerArgLeu
LeuGlnGluThrSerGluGlnLeuValAlaLeuLysProTrpIleThrArgGlnAsnPheSerArgCysLeuGlu
LeuGlnCysGlnProAspSerSerThrLeuGlyGlyGlySerGlyGlyGlySerGlyGlyGlySerGlyGlyGly
SerGlyGlyGlySerGlyThrGlnAspCysSerPheGlnHisSerProIleSerSerAspPheAlaValLysIle
ArgGluLeuSerAspTyrLeuLeuGlnAspTyrProValThrValAlaSerAsnLeuGln SEQ ID NO:705 pMON32188.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer
LysGluSerHisLysSerProAsnMetAlaAsnLeuGlnAspGluGluLeuCysGlyGlyLeuTrpArgLeuVal
LeuAlaGlnArgTrpMetGluArgLeuLysThrValAlaGlySerLysMetGlnGlyLeuLeuGluArgValAsn
ThrGluIleHisPheValThrLysCysAlaPheGlnProProProSerCysLeuArgPheValGlnIleAsnIle
SerArgLeuLeuGlnGluThrSerGluGlnLeuValAlaLeuLysProTrpIleThrArgGlnAsnPheSerArg
CysLeuGluLeuGlnCysGlnProAspSerSerThrLeuGlyGlyGlySerGlyGlyGlySerGlyGlyGlySer
GlyGlyGlySerGlyGlyGlySerGlyThrGlnAspCysSerPheGlnHisSerProIleSerSerAspPheAla
ValLysIleArgGluLeuSerAspTyrLeuLeuGlnAspTyrProValThrValAlaSer SEQ ID NO:706 pMON32273.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer
LysGluSerHisLysSerProAsnMetAlaProProSerCysLeuArgPheValGlnThrAsnIleSerArgLeu
LeuGlnGluThrSerGluGlnLeuValAlaLeuLysProTrpIleThrArgGlnAsnPheSerArgCysLeuGlu
LeuGlnCysGlnProAspSerSerThrLeuGlyGlyGlySerGlyGlyGlySerGlyGlyGlySerGlyGlyGly
SerGlyGlyGlySerGlyThrGlnAspCysSerPheGlnHisSerProIleSerSerAspPheAlaValLysIle
ArgGluLeuSerAspTyrLeuLeuGlnAspTyrProValThrValAlaSerAsnLeuGlnAspGluGluLeuCys
GlyGlyLeuTrpArgLeuValLeuAlaGlnArgTrpMetGluArgLeuLysThrValAlaGlySerLysMetGln
GlyLeuLeuGluArgValAsnThrGluIleHisPheValThrLysCysAlaPheGlnPro SEQ ID NO:707 pMON35795.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer
LysGluSerHisLysSerProAsnMetAlaLeuGlnAspGluGluLeuCysGlyGlyLeuTrpArgLeuValLeu
AlaGlnArgTrpMetGluArgLeuLysThrValAlaGlySerLysMetGlnGlyLeuLeuGluArgValAsnThr
GluIleHisPheValThrLysCysAlaPheGlnProProProSerCysLeuArgPheValGlnThrAsnIleSer
ArgLeuLeuGlnGluThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyGlySerGlyGlyGlySerGly
GlyGlySerGlyGlyGlySerGlyThrGlnAspCysSerPheGlnHisSerProIleSerSerAspPheAlaVal
LysIleArgGluLeuSerAspTyrLeuLeuGlnAspTyrProValThrValAlaSerAsn SEQ ID NO:708 pMON35796.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer
LysGluSerHisLysSerProAsnMetAlaGlnAspGluGluLeuCysGlyGlyLeuTrpArgLeuValLeuAla
GlnArgTrpMetGluArgLeuLysThrValAlaGlySerLysMetGlnGlyLeuLeuGluArgValAsnThrGlu
IleHisPheValThrLysCysAlaPheGlnProProProSerCysLeuArgPheValGlnThrAsnIleSerArg
LeuLeuGlnGluThrSerGluGlnLeuValAlaLeuLysProTrpIleThrArgGlnAsnPheSerArgCysLeu
GluLeuGlnCysGlnProAspSerSerThrLeuGlyGlyGlySerGlyGlyGlySerGlyGlyGlySerGlyGly

TABLE 3-continued

PROTEIN SEQUENCES

GlySerGlyGlyGlySerGlyThrGlnAspCysSerPheGlnHisSerProIleSerSerAspPheAlaValLys
IleArgGluLeuSerAspTyrLeuLeuGlnAspTyrProValThrValAlaSerAsnLeu SEQ ID NO:709 pMON35797.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer
LysGluSerHisLysSerProAsnMetAlaGluLeuCysGlyLeuTrpArgLeuValLeuAlaGlnArgTrp
TrpMetGluArgLeuLysThrValAlaGlySerLysMetGlnGlyLeuLeuGluArgValAsnThrGluIleHis
PheValThrLysCysAlaPheGlnProProProSerCysLeuArgPheValGlnThrAsnIleSerArgLeuLeu
GlnGluThrSerGluGlnLeuValAlaLeuLysProTrpIleThrArgGlnAsnPheSerArgCysLeuGluLeu
GlnCysGlnProAspSerSerThrLeuGlyGlyGlySerGlyGlyGlySerGlyGlyGlySerGlyGlyGlySer
GlyGlySerGlyThrGlnAspCysSerPheGlnHisSerProIleSerSerAspPheAlaValLysIleArg
GluLeuSerAspTyrLeuLeuGlnAspTyrProValThrValAlaSerAsnLeuGlnAsp SEQ ID NO:710 pMON35798.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer
LysGluSerHisLysSerProAsnMetAlaGluLeuCysGlyGlyLeuTrpArgLeuValLeuAlaGlnArgTrp
MetGluArgLeuLysThrValAlaGlySerLysMetGlnGlyLeuLeuGluArgValAsnThrGluIleHisPhe
ValThrLysCysAlaPheGlnProProProSerCysLeuArgPheValGlnThrAsnIleSerArgLeuLeuGln
GluThrSerGluGlnLeuValAlaLeuLysProTrpIleThrArgGlnAsnPheSerArgCysLeuGluLeuGln
CysGlnProAspSerSerThrLeuGlyGlyGlySerGlyGlyGlySerGlyGlyGlySerGlyGlyGlySerGly
GlyGlySerGlyThrGlnAspCysSerPheGlnHisSerProIleSerSerAspPheAlaValLysIleArgGlu
LeuSerAspTyrLeuLeuGlnAspTyrProValThrValAlaSerAsnLeuGlnAspGlu SEQ ID NO:711 pMON35799.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer
LysGluSerHisLysSerProAsnMetAlaLeuCysGlyGlyLeuTrpArgLeuValLeuAlaGlnArgTrpMet
GluArgLeuLysThrValAlaGlySerLysMetGlnGlyLeuLeuGluArgValAsnThrGluIleHisPheVal
ThrLysCysAlaPheGlnProProProSerCysLeuArgPheValGlnThrAsnIleSerArgLeuLeuGlnGlu
ThrSerGluGlnLeuValAlaLeuLysProTrpIleThrArgGlnAsnPheSerArgCysLeuGluLeuGlnCys
GlnProAspSerSerThrLeuGlyGlyGlySerGlyGlyGlySerGlyGlyGlySerGlyGlyGlySerGlyGly
GlySerGlyThrGlnAspCysSerPheGlnHisSerProIleSerSerAspPheAlaValLysIleArgGluLeu
SerAspTyrLeuLeuGlnAspTyrProValThrValAlaSerAsnLeuGlnAspGluGlu SEQ ID NO:712 pMON39914.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer
LysGluSerHisLysSerProAsnMetAlaAspGluLeuCysGlyGlyLeuTrpArgLeuValLeuAlaGln
ArgTrpMetGluArgLeuLysThrValAlaGlySerLysMetGlnGlyLeuLeuGluArgValAsnThrGluIle
HisPheValThrLysCysAlaPheGlnProProProSerCysLeuArgPheValGlnThrAsnIleSerArgLeu
LeuGlnGluThrSerGluGlnLeuValAlaLeuLysProTrpIleThrArgGlnAsnPheSerArgCysLeuGlu
LeuGlnCysGlnProAspSerSerThrLeuProProProTrpSerProArgProLeuGlyAlaThrAlaProThr
ThrGlnAspCysSerPheGlnHisSerProIleSerSerAspPheAlaValLysIleArgGluLeuSerAspTyr
LeuLeuGlnAspTyrProValThrValAlaSerAsnLeuGln SEQ ID NO:713

TABLE 3-continued

PROTEIN SEQUENCES pMON39915.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlySerProGlyGluProSerGlyProIleSerThrIleAsnProSerProProSer
LysGluSerHisLysSerProAsnMetAlaAspGluGluLeuCysGlyGlyLeuTrpArgLeuValLeuAlaGln
ArgTrpMetGluArgLeuLysThrValAlaGlySerLysMetGlnGlyLeuLeuGluArgValAsnThrGluIle
HisPheValThrLysCysAlaPheGlnProProProSerCysLeuArgPheValGlnThrAsnIleSerArgLeu
LeuGlnGluThrSerGluGlnLeuValAlaLeuLysProTrpIleThrArgGlnAsnPheSerArgCysLeuGlu
LeuGlnCysGlnProAspSerSerThrLeuGlyGlyGlySerGlyGlyGlySerGlyGlyGlySerGlyGlyGly
SerGlyGlyGlySerGlyGlyGlySerGlyGlyGlySerGlyThrGlnAspCysSerPheGlnHisSerProIle
SerSerAspPheAlaValLysIleArgGluLeuSerAspTyrLeuLeuGlnAspTyrProValThrValAlaSer
AsnLeuGln SEQ ID NO:714 pMON39916.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlySerProGlyGluProSerGlyProIleSerThrIleAsnProSerProProSer
LysGluSerHisLysSerProAsnMetAlaAspGluGluLeuCysGlyGlyLeuTrpArgLeuValLeuAlaGln
ArgTrpMetGluArgLeuLysThrValAlaGlySerLysMetGlnGlyLeuLeuGluArgValAsnThrGluIle
HisPheValThrLysCysAlaPheGlnProProProSerCysLeuArgPheValGlnThrAsnIleSerArgLeu
LeuGlnGluThrSerGluGlnLeuValAlaLeuLysProTrpIleThrArgGlnAsnPheSerArgCysLeuGlu
LeuGlnCysGlnProAspSerSerThrLeuProProProTrpSerProArgProLeuGlyAlaThrAlaProThr
AlaGlyGlnProProLeuThrGlnAspCysSerPheGlnHisSerProIleSerSerAspPheAlaValLysIle
ArgGluLeuSerAspTyrLeuLeuGlnAspTyrProValThrValAlaSerAsnLeuGln SEQ ID NO:715 pMON35712.pep

AlaAspTyrProValThrValAlaSerAsnLeuGlnAspGluGluLeuCysGlyGlyLeuTrpArgLeuValLeu
AlaGlnArgTrpMetGluArgLeuLysThrValAlaGlySerLysMetGlnGlyLeuLeuGluArgValAsnThr
GluIleHisPheValThrLysCysAlaPheGlnProProProSerCysLeuArgPheValGlnThrAsnIleSer
ArgLeuLeuGlnGluThrSerGluGlnLeuValAlaLeuLysProTrpIleThrArgGlnAsnPheSerArgCys
LeuGluLeuGlnCysGlnProAspSerSerThrLeuGlyGlyGlySerGlyGlyGlySerGlyGlyGlySerGly
GlyGlyThrGlnAspCysSerPheGlnHisSerProIleSerSerAspPheAlaValLysIleArgGluLeuSer
AspTyrLeuLeuGln SEQ ID NO:716 pMON35713.pep

AlaAlaSerAsnLeuGlnAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGluIleHisPheValThr
LysCysAlaPheGlnProProProSerCysLeuArgPheValGlnThrAsnIleSerArgLeuLeuGlnGluThr
SerGluGlnLeuValAlaLeuLysProTrpIleThrArgGlnAsnPheSerArgCysLeuGluLeuGlnCysGln
ProAspSerSerThrLeuGlyGlyGlySerGlyGlyGlySerGlyGlyGlySerGlyGlyGlyThrGlnAspCys
SerPheGlnHisSerProIleSerSerAspPheAlaValLysIleArgGluLeuSerAspTyrLeuLeuGlnAsp
TyrProValThrVal SEQ ID NO:717 pMON35714.pep

AlaValAlaGlySerLysMetGlnGlyLeuLeuGluArgValAsnThrGluIleHisPheValThrLysCysAla
PheGlnProProProSerCysLeuArgPheValGlnThrAsnIleSerArgLeuLeuGlnGluThrSerGluGln
LeuValAlaLeuLysProTrpIleThrArgGlnAsnPheSerArgCysLeuGluLeuGlnCysGlnProAspSer
SerThrLeuGlyGlyGlySerGlyGlyGlySerGlyGlyGlySerGlyGlyGlyThrGlnAspCysSerPheGln
HisSerProIleSerSerAspPheAlaValLysIleArgGluLeuSerAspTyrLeuLeuGlnAspTyrProVal
ThrValAlaSerAsnLeuGlnAspGluGluLeuCysGlyGlyLeuTrpArgLeuValLeuAlaGlnArgTrpMet
GluArgLeuLysThr SEQ ID NO:718 pMON35715.pep

AlaSerLysMetGlnGlyLeuLeuGluArgValAsnThrGluIleHisPheValThrLysCysAlaPheGlnPro
ProProSerCysLeuArgPheValGlnThrAsnIleSerArgLeuLeuGlnGluThrSerGluGlnLeuValAla
LeuLysProTrpIleThrArgGlnAsnPheSerArgCysLeuGluLeuGlnCysGlnProAspSerSerThrLeu
GlyGlyGlySerGlyGlyGlySerGlyGlyGlySerGlyGlyGlyThrGlnAspCysSerPheGlnHisSerPro
IleSerSerAspPheAlaValLysIleArgGluLeuSerAspTyrLeuLeuGlnAspTyrProValThrValAla
SerAsnLeuGlnAspGluGluLeuCysGlyGlyLeuTrpArgLeuValLeuAlaGlnArgTrpMetGluArgLeu
LysThrValAlaGly SEQ ID NO:719

TABLE 3-continued

PROTEIN SEQUENCES pMON35716.pep

AlaProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlyThrGlnAspCysSerPheGlnHisSer
ProIleSerSerAspPheAlaValLysIleArgGluLeuSerAspTyrLeuLeuGlnAspTyrProValThrVal
AlaSerAsnLeuGlnAspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIleHisPheValThrLys
CysAlaPheGlnPro SEQ ID NO:720 pMON35717.pep

AlaArgPheValGlnThrAsnIleSerArgLeuLeuGlnGluThrSerGluGlnLeuValAlaLeuLysProTrp
IleThrArgGlnAsnPheSerArgCysLeuGluLeuGlnCysGlnProAspSerSerThrLeuGlyGlyGlySer
GlyGlyGlySerGlyGlyGlySerGlyGlyGlyThrGlnAspCysSerPheGlnHisSerProIleSerSerAsp
PheAlaValLysIleArgGluLeuSerAspTyrLeuLeuGlnAspTyrProValThrValAlaSerAsnLeuGln
AspGluGluLeuCysGlyGlyLeuTrpArgLeuValLeuAlaGlnArgTrpMetGluArgLeuLysThrValAla
GlySerLysMetGlnGlyLeuLeuGluArgValAsnThrGluIleHisPheValThrLysCysAlaPheGlnPro
ProProSerCysLeu SEQ ID NO:721 pMON35718.pep

AlaThrAsnIleSerArgLeuLeuGlnGluThrSerGluGlnLeuValAlaLeuLysProTrpIleThrArgGln
AsnPheSerArgCysLeuGluLeuGlnCysGlnProAspSerSerThrLeuGlyGlyGlySerGlyGlyGlySer
GlyGlyGlySerGlyGlyGlyThrGlnAspCysSerPheGlnHisSerProIleSerSerAspPheAlaValLys
IleArgGluLeuSerAspTyrLeuLeuGlnAspTyrProValThrValAlaSerAsnLeuGlnAspGluGluLeu
CysGlyGlyLeuTrpArgLeuValLeuAlaGlnArgTrpMetGluArgLeuLysThrValAlaGlySerLysMet
GlnGlyLeuLeuGluArgValAsnThrGluIleHisPheValThrLysCysAlaPheGlnProProProSerCys
LeuArgPheValGln SEQ ID NO:722 pMON32170.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAlaSerAsnLeuGlnTyrValGlyGlyGlySerProGlyGluProSerGly
ProIleSerThrIleAsnProSerProProSerLysGluSerHisLysSerProAsnMetAlaThrProLeuGly
ProAlaSerSerLeuProGlnSerPheLeuLeuLysSerLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValLeuArgHisLeuAlaGlnPro SEQ ID NO:723 pMON32187.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAlaSerAsnLeuGlnTyrValGluGlyGlyGlySerProGlyGluProSerGly
ProIleSerThrIleAsnProSerProProSerLysGluSerHisLysSerProAsnMetAlaThrProLeuGly
ProAlaSerSerLeuProGlnSerPheLeuLeuLysCysLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValLeuArgHisLeuAlaGlnPro SEQ ID NO:724 pMON32271.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuProProProTrpSerProArgProLeuGlyAlaThrAlaProThrAlaGlyInProProLeuThrGlnAsp
CysSerPheGlnHisSerProIleSerSerAspPheAlaValLysIleArgGluLeuSerAspTyrLeuLeuAsp
AspTyrProValThrValAlaSerAsnLeuTyrValGluGlyGlyGlySerProGlyGlyGlySerGlyGly
GlySerAsnMetAlaThrProLeuGlyProAlaSerSerLeuProGlnSerPheLeuLeuLysSerLeuGluGln
ValArgLysIleGlnGlyAspGlyAlaAlaLeuGlnGluLysLeuCysAlaThrTyrLysLeuCysHisProGlu

TABLE 3-continued

PROTEIN SEQUENCES

GluLeuValLeuLeuGlyHisSerLeuGlyIleProTrpAlaProLeuSerSerCysProSerGlnAlaLeuGln
LeuAlaGlyCysLeuSerGlnLeuHisSerGlyLeuPheLeuTyrGlnGlyLeuLeuGlnAlaLeuGluGlyIle
SerProGluLeuGlyProThrLeuAspThrLeuGlnLeuAspValAlaAspPheAlaThrThrIleTrpGlnGln
MetGluGluLeuGlyMetAlaProAlaLeuGlnProThrGlnGlyAlaMetProAlaPheAlaSerAlaPheGln
ArgArgAlaGlyGlyValLeuValAlaSerHisLeuGlnSerPheLeuGluValSerTyrArgValLeuArgHis
LeuAlaGlnPro SEQ ID NO:725 pMON32272.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyGlyGlySer
GlyGlyGlySerGlyThrGlnAspCysSerPheGlnHisSerProIleSerSerAspPheAlaValLysIleArg
GluLeuSerAspTyrLeuLeuGlnAspTyrProValThrValAlaSerAsnLeuGlnTyrValGluGlyGlyGly
GlySerProGlyGlyGlySerGlyGlyGlySerAsnMetAlaThrProLeuGlyProAlaSerSerLeuProGln
SerPheLeuLeuLysSerLeuGluGlnValArgLysIleGlnGlyAspGlyAlaAlaLeuGlnGluLysLeuCys
AlaThrTyrLysLeuCysHisProGluGluLeuValLeuLeuGlyHisSerLeuGlyIleProTrpAlaProLeu
SerSerCysProSerGlnAlaLeuGlnLeuAlaGlyCysLeuSerGlnLeuHisSerGlyLeuPheLeuTyrGln
GlyLeuLeuGlnAlaLeuGluGlyIleSerProGluLeuGlyProThrLeuAspThrLeuGlnLeuAspValAla
AspPheAlaThrThrIleTrpGlnGlnMetGluGluLeuGlyMetAlaProAlaLeuGlnProThrGlnGlyAla
MetProAlaPheAlaSerAlaPheGlnArgArgAlaGlyGlyValLeuValAlaSerHisLeuGlnSerPheLeu
GluValSerTyrArgValLeuArgHisLeuAlaGlnPro SEQ ID NO:726 pMON32274.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuProProProTrpSerProArgProLeuGlyAlaThrAlaProThrThrGlnAspCysSerPheGlnHisSer
ProIleSerSerAspPheAlaValLysIleArgGluLeuSerAspTyrLeuLeuGlnAspTyrProValThrVal
AlaSerAsnLeuTyrValGluGlyGlyGlyGlySerProGlyGlyGlySerGlyGlyGlySerAsnMetAlaThr
ProLeuGlyProAlaSerSerLeuProGlnSerPheLeuLeuLysSerLeuGluGlnValArgLysIleGlnGly
AspGlyAlaAlaLeuGlnGluLysLeuCysAlaThrTyrLysLeuCysHisProGluGluLeuValLeuLeuGly
HisSerLeuGlyIleProTrpAlaProLeuSerSerCysProSerGlnAlaLeuGlnLeuAlaGlyCysLeuSer
GlnLeuHisSerGlyLeuPheLeuTyrGlnGlyLeuLeuGlnAlaLeuGluGlyIleSerProGluLeuGlyPro
ThrLeuAspThrLeuGlnLeuAspValAlaAspPheAlaThrThrIleTrpGlnGlnMetGluGluLeuGlyMet
AlaProAlaLeuGlnProThrGlnGlyAlaMetProAlaPheAlaSerAlaPheGlnArgArgAlaGlyGlyVal
LeuValAlaSerHisLeuGlnSerPheLeuGluValSerTyrArgValLeuArgHisLeuAlaGlnPro SEQ ID NO:727 pMON35751.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuArgProTrpIleThrArgGlnAsnPheSerArgCysLeuGluLeuGlnCysGlnProAspSerSerThr
LeuGlyGlyGlySerGlyGlyGlySerGlyGlyThrGlnAspCysSerPheGlnHisSerProIleSerSerAsp
PheAlaValLysIleArgGluLeuSerAspTyrLeuLeuGlnAspTyrProValThrValAlaSerAsnLeuGln
TyrValGluGlyGlyGlyGlySerProGlyGluProSerGlyProIleSerThrIleAsnProSerProProSer
LysGluSerHisLysSerProAsnMetAlaThrProLeuGlyProAlaSerSerLeuProGlnSerPheLeuLeu
LysCysLeuGluGlnValArgLysIleGlnGlyAspGlyAlaAlaLeuGlnGluLysLeuCysAlaThrTyrLys
LeuCysHisProGluGluLeuValLeuLeuGlyHisSerLeuGlyIleProTrpAlaProLeuSerSerCysPro
SerGlnAlaLeuGlnLeuAlaGlyCysLeuSerGlnLeuHisSerGlyLeuPheLeuTyrGlnGlyLeuLeuGln
AlaLeuGluGlyIleSerProGluLeuGlyProThrLeuAspThrLeuGlnLeuAspValAlaAspPheAlaThr
ThrIleTrpGlnGlnMetGluGluLeuGlyMetAlaProAlaLeuGlnProThrGlnGlyAlaMetProAlaPhe
AlaSerAlaPheGlnArgArgAlaGlyGlyValLeuValAlaSerHisLeuGlnSerPheLeuGluValSerTyr
ArgValLeuArgHisLeuAlaGlnPro SEQ ID NO:728 pMON35752.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlyThrGlnAspCysSerPheGlnHisSer
ProIleSerSerAspPheAlaValLysIleArgGluLeuSerAspTyrLeuLeuGlnAspTyrProValThrVal
AlaSerAsnLeuGlnTyrValGluGlyGlyGlyGlySerProGlyGluProSerGlyProIleSerThrIleAsn
ProSerProProSerLysGluSerHisLysSerProAsnMetAlaThrProLeuGlyProAlaSerSerLeuPro
GlnSerPheLeuLeuLysCysLeuGluGlnValArgLysIleGlnGlyAspGlyAlaAlaLeuGlnGluLysLeu
CysAlaThrTyrLysLeuCysHisProGluGluLeuValLeuLeuGlyHisSerLeuGlyIleProTrpAlaPro
LeuSerSerCysProSerGlnAlaLeuGlnLeuAlaGlyCysLeuSerGlnLeuHisSerGlyLeuPheLeuTyr
GlnGlyLeuLeuGlnAlaLeuGluGlyIleSerProGluLeuGlyProThrLeuAspThrLeuGlnLeuAspVal
AlaAspPheAlaThrThrIleTrpGlnGlnMetGluGluLeuGlyMetAlaProAlaLeuGlnProThrGlnGly
AlaMetProAlaPheAlaSerAlaPheGlnArgArgAlaGlyGlyValLeuValAlaSerHisLeuGlnSerPhe
LeuGluValSerTyrArgValLeuArgHisLeuAlaGlnPro SEQ ID NO:729

TABLE 3-continued

PROTEIN SEQUENCES pMON35753.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAlaSerAsnLeuGlnTyrValGluGlyGlyGlyGlySerProGlyGluProSerGly
ProIleSerThrIleAsnProSerProProSerLysGluSerHisLysSerProAsnMetAlaThrProLeuGly
ProAlaSerSerLeuProGlnSerPheLeuLeuLysCysLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyLeuSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValValArgHisLeuAlaGlnPro SEQ ID NO:730 pMON35754.pep

AlaProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlyThrGlnAspCysSerPheGlnHisSer
ProIleSerSerAspPheAlaValLysIleArgGluLeuSerAspTyrLeuLeuGlnAspTyrProValThrVal
AlaSerAsnLeuGlnAspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIleHisPheValThrLys
CysAlaPheGlnProTyrValGluGlyGlyGlySerProGlyGluProSerGlyProIleSerThrIleAsn
ProSerProProSerLysGluSerHisLysSerProAsnMetAlaThrProLeuGlyProAlaSerSerValPro
GlnSerPheLeuLeuLysCysLeuGluGlnValArgLysIleGlnGlyAspGlyAlaAlaLeuGlnGluLysLeu
CysAlaThrTyrLysLeuCysHisProGluGluLeuValLeuLeuGlyHisSerLeuGlyIleProTrpAlaPro
LeuSerSerCysProSerGlnAlaLeuGlnLeuAlaGlyCysLeuSerGlnLeuHisSerGlyLeuPheLeuTyr
GlnGlyLeuLeuGlnAlaLeuGluGlyIleSerProGluLeuGlyProThrLeuAspThrLeuGlnLeuAspVal
AlaAspPheAlaThrThrIleTrpGlnGlnMetGluGluLeuGlyMetAlaProAlaLeuGlnProThrGlnGly
AlaMetProAlaPheAlaSerAlaPheGlnArgArgAlaGlyGlyValLeuValAlaSerHisLeuGlnSerPhe
LeuGluValSerTyrArgValIleArgHisLeuAlaGlnPro SEQ ID NO:731 pMON35755.pep

AlaSerAsnLeuGlnAspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIleHisPheValThrLys
CysAlaPheGlnProProProSerCysLeuArgPheValGlnThrAsnIleSerArgLeuLeuGlnGluThrSer
GluGlnLeuValAlaLeuLysProTrpIleThrArgGlnAsnPheSerArgCysLeuGluLeuGlnCysGlnPro
AspSerSerThrLeuGlyGlyGlySerGlyGlyGlySerGlyGlyGlySerGlyGlyGlySerGlyGlyGlySer
GlyThrGlnAspCysSerPheGlnHisSerProIleSerSerAspPheAlaValLysIleArgGluLeuSerAsp
TyrLeuLeuGlnAspTyrProValThrValAlaTyrValGluGlyGlyGlyGlySerProGlyGluProSerGly
ProIleSerThrIleAsnProSerHisProSerLysGluSerHisLysSerProAsnMetAlaThrProLeuGly
ProAlaSerSerLeuProGlnSerPheLeuLeuLysCysLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValLeuArgHisLeuAlaGlnPro SEQ ID NO:732 pMON35756.pep

AlaAsnLeuGlnAspGluGluLeuCysGlyGlyLeuTrpArgLeuValLeuAlaGlnArgTrpMetGluArgLeu
LysThrValAlaGlySerLysMetGlnGlyLeuLeuGluArgValAsnThrGluIleHisPheValThrLysCys
AlaPheGlnProProProSerCysLeuArgPheValGlnThrAsnIleSerArgLeuLeuGlnGluThrSerGlu
GlnLeuValAlaLeuLysProTrpIleThrArgGlnAsnPheSerArgCysLeuGluLeuGlnCysGlnProAsp
SerSerThrLeuGlyGlyGlySerGlyGlyGlySerGlyGlyGlySerGlyGlyGlySerGlyGlyGlySerGly
ThrGlnAspCysSerPheGlnHisSerProIleSerSerAspPheAlaValLysIleArgGluLeuSerAspTyr
LeuLeuGlnAspTyrProValThrValAlaSerTyrValGluGlyGlyGlyGlySerProGlyGluProSerGly
ProIleSerThrIleAsnProSerProProSerLysGluSerHisLysSerProAsnMetAlaThrProLeuGly
ProAlaSerSerLeuProGlnSerPheLeuLeuLysCysLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValIleArgHisLeuAlaGlnPro SEQ ID NO:733 pMON35757.pep

AlaLeuGlnAspGluGluLeuCysGlyGlyLeuTrpArgLeuValLeuAlaGlnArgLeuMetGluArgLeuLys
ThrValAlaGlySerLysMetGlnGlyLeuLeuGluArgValAsnThrGluIleHisPheValThrLysCysAla
PheGlnProProProSerCysLeuArgPheValGlnThrAsnIleSerArgLeuLeuGlnGluThrSerGluGln

TABLE 3-continued

PROTEIN SEQUENCES

LeuValAlaLeuLysProTrpIleThrArgGlnAsnPheSerArgCysLeuGluLeuGlnCysGlnProAspSer
SerThrLeuGlyGlyGlyGlySerGlyGlyGlySerGlyGlyGlySerGlyGlyGlySerGlyThr
GlnAspCysSerPheGlnHisSerProIleSerSerAspPheAlaValLysIleArgGluLeuSerAspTyrLeu
LeuGlnAspTyrProValThrValAlaSerAsnTyrValGluGlyGlyGlySerProGlyGluProSerGly
ProIleSerThrIleAsnProSerProProSerLysGluSerHisLysSerProAsnMetAlaThrProLeuGly
ProAlaSerSerLeuProGlnSerPheLeuLeuLysCysLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValLeuArgHisLeuAlaGlnPro SEQ ID NO:734 pMON35758.pep

AlaLeuCysGlyGlyLeuTrpArgLeuValLeuAlaGlnArgTrpMetGluArgLeuLysThrValAlaGlySer
LysMetGlnGlyLeuLeuGluArgValAsnThrGluIleHisPheValThrLysCysAlaPheGlnProProPro
SerCysLeuArgPheValGlnThrAsnIleSerArgLeuLeuGlnGluThrSerGluGlnLeuValAlaLeuLys
ProTrpIleThrArgGlnAsnPheSerArgCysLeuGluLeuGlnCysGlnProAspSerSerThrLeuGlyGly
GlySerGlyGlyGlySerGlyGlyGlySerGlyGlyGlySerGlyGlyGlySerGlyThrGlnAspCysSerPhe
GlnHisSerProIleSerSerAspPheAlaValLysIleArgGluLeuSerAspTyrLeuLeuGlnAspTyrPro
ValThrValAlaSerAsnLeuGlnAspGluGluTyrValGluGlyGlyGlySerProGlyGluProSerGly
ProIleSerThrIleAsnProSerProProSerLysGluSerHisLysSerProAsnMetAlaThrProLeuGly
ProAlaSerSerLeuProGlnSerPheLeuLeuLysCysLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValLeuArgHisLeuAlaGlnPro SEQ ID NO:735 pMON35759.pep

AlaSerLysMetGlnGlyLeuLeuGluArgValAsnThrGluIleHisPheValThrLysCysAlaPheGlnPro
ProProSerCysLeuArgPheValGlnThrAsnIleSerArgLeuLeuGlnGluThrSerGluGlnLeuValAla
LeuLysProTrpIleThrArgGlnAsnPheSerArgCysLeuGluLeuGlnCysGlnProAspSerSerThrLeu
GlyGlyGlySerGlyGlyGlySerGlyGlyGlySerGlyGlyGlyThrGlnAspCysSerPheGlnHisSerPro
IleSerSerAspPheAlaValLysIleArgGluLeuSerAspTyrLeuLeuGlnAspTyrProValThrValAla
SerAsnLeuGlnAspGluGluLeuCysGlyGlyLeuTrpArgLeuValLeuAlaGlnArgTrpMetGluArgLeu
LysThrValAlaGlyTyrValGluGlyGlyGlySerProGlyGluProSerGlyProIleSerThrIleAsn
ProSerProProSerLysGluSerHisLysSerProAsnMetAlaThrProLeuGlyProAlaSerSerLeuPro
GlnSerPheLeuLeuLysCysLeuGluGlnValArgLysIleGlnGlyAspGlyAlaAlaLeuGlnGluLysLeu
CysAlaThrTyrLysLeuCysHisProGluGluLeuValLeuLeuGlyHisSerLeuGlyIleProTrpAlaPro
LeuSerSerCysProSerGlnAlaLeuGlnLeuAlaGlyCysLeuSerGlnLeuHisSerGlyLeuPheLeuTyr
GlnGlyLeuLeuGlnAlaLeuGluGlyIleSerProGluLeuGlyProThrLeuAspThrLeuGlnLeuAspVal
AlaAspPheAlaThrThrIleTrpGlnGlnMetGluGluLeuGlyMetAlaProAlaLeuGlnProThrGlnGly
AlaMetProAlaPheAlaSerAlaPheGlnArgArgAlaGlyGlyValLeuValAlaSerHisLeuGlnSerPhe
LeuGluValSerTyrArgValLeuArgHisLeuAlaGlnPro SEQ ID NO:736 pMON35760.pep

AlaSerLysMetGlnGlyLeuLeuGluArgValAsnThrGluIleHisPheValThrLysCysAlaPheGlnPro
ProProSerCysLeuArgPheValGlnThrAsnIleSerArgLeuLeuGlnGluThrSerGluGlnLeuValAla
LeuLysProTrpIleThrArgGlnAsnPheSerArgCysLeuGluLeuGlnCysGlnProAspSerSerThrLeu
GlyGlyGlySerGlyGlyGlySerGlyGlyGlySerGlyGlyGlyThrGlnAspCysSerPheGlnHisSerPro
IleSerSerAspPheAlaValLysIleArgGluLeuSerAspTyrLeuLeuGlnAspTyrProValThrValAla
SerAsnLeuGlnAspGluGluLeuCysGlyGlyLeuTrpArgLeuValLeuAlaGlnArgTrpMetGluArgLeu
LysThrValAlaGlyTyrValGluGlyGlyGlySerProGlyGluProSerGlyProIleSerThrIleAsn
ProSerProProSerLysGluSerHisLysSerProAsnMetAlaThrProLeuGlyProAlaSerSerLeuPro
GlnSerPheLeuLeuLysCysLeuGluGlnValArgLysIleGlnGlyAspGlyAlaAlaLeuGlnGluLysLeu
CysAlaThrTyrLysLeuCysHisProGluGluLeuValLeuLeuGlyHisSerLeuGlyIleProTrpAlaPro
LeuSerSerCysProSerGlnAlaLeuGlnLeuAlaGlyCysLeuSerGlnLeuHisSerGlyLeuPheLeuTyr
GlnGlyLeuLeuGlnAlaLeuGluGlyIleSerProGluLeuGlyProThrLeuAspThrLeuGlnLeuAspVal
AlaAspPheAlaThrThrIleTrpGlnGlnMetGluGluLeuGlyMetAlaProAlaLeuGlnProThrGlnGly
AlaMetProAlaPheAlaSerAlaPheGlnArgArgAlaGlyGlyValLeuValAlaSerHisLeuGlnSerPhe
LeuGluValSerTyrArgValLeuArgHisLeuAlaGlnPro SEQ ID NO:737 pMON35761.pep

AlaLeuCysGlyGlyLeuTrpArgLeuValLeuAlaGlnArgTrpMetGluArgLeuLysThrValAlaGlySer
LysMetGlnGlyLeuLeuGluArgValAsnThrGluIleHisPheValThrLysCysAlaPheGlnProProPro
SerCysLeuArgPheValGlnThrAsnIleSerArgLeuLeuGlnGluThrSerGluGlnLeuValAlaLeuLys
ProTrpIleThrArgGlnAsnPheSerArgCysLeuGluLeuGlnCysArgProAspSerSerThrLeuGlyGly
GlySerGlyGlyGlySerGlyGlyGlySerGlyGlyGlySerGlyGlyGlySerGlyThrGlnAspCysSerPhe
GlnHisSerProIleSerSerAsnPheAlaValLysIleArgGluLeuSerAspTyrLeuLeuGlnAspTyrPro
ValThrValAlaSerAsnLeuGlnAspGluGluTyrValGluGlyGlyGlyGlySerProGlyGluProSerGly
ProIlePheThrIleAsnProSerProProSerLysGluSerHisLysSerProAsnMetAlaThrProLeuGly

TABLE 3-continued

PROTEIN SEQUENCES

ProAlaSerSerLeuProGlnSerPheLeuLeuLysCysLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValLeuArgHisLeuAlaGlnPro SEQ ID NO:738 pMON35762.pep

AlaGluLeuCysGlyGlyLeuTrpArgLeuValLeuAlaGlnArgTrpMetGluArgLeuLysThrValAlaGly
SerLysMetGlnGlyLeuLeuGluArgValAsnThrGluIleHisPheValThrLysCysAlaPheGlnProPro
ProSerCysLeuArgPheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAspSerSerThrLeuGly
GlyGlyGlySerGlyGlyGlySerGlyGlyGlySerGlyGlyGlySerGlyThrGlnAspCysSer
PheGlnHisSerProIleSerSerAspPheAlaValLysIleArgGluLeuSerAspTyrLeuLeuGlnAspTyr
ProValThrValAlaSerAsnLeuGlnAspGluTyrValGluGlyGlyGlyGlySerProGlyGluProSerGly
ProIleSerThrIleAsnProSerProProSerLysGluSerHisLysSerProAsnMetAlaThrProLeuGly
ProAlaSerSerLeuProGlnSerPheLeuLeuLysCysLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValLeuArgHisLeuAlaGlnPro SEQ ID NO:739 pMON35763.pep

AlaGluGluLeuCysGlyGlyLeuTrpArgLeuValLeuAlaGlnArgTrpMetGluArgLeuLysThrValAla
GlySerLysMetGlnGlyLeuLeuGluArgValAsnThrGluIleHisPheValThrLysCysAlaPheGlnPro
ProProSerCysLeuArgPheValGlnThrAsnIleSerArgLeuLeuGlnGluThrSerGluGlnLeuValAla
LeuLysProTrpIleThrArgGlnAsnPheSerArgCysLeuGluLeuGlnCysGlnProAspSerSerThrLeu
GlyGlyGlySerGlyGlyGlySerGlyGlyGlySerGlyGlyGlySerGlyThrGlnAspCys
SerPheGlnHisSerProIleSerSerAspPheAlaValLysIleArgGluLeuSerAspTyrLeuLeuGlnAsp
TyrProValThrValAlaSerAsnLeuGlnAspGluTyrValGluGlyGlyGlyGlySerProGlyGluProSerGly
ProIleSerThrIleAsnProSerProProSerLysGluSerHisLysSerProAsnMetAlaThrProLeuGly
ProAlaSerSerLeuProGlnSerPheLeuLeuLysCysLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValLeuArgHisLeuAlaGlnPro SEQ ID NO:740 pMON35764.pep

AlaGlnAspGluGluLeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheValThrLysCysAlaPhe
GlnProProProSerCysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCysGlnProAspSerSer
ThrLeuGlyGlyGlySerGlyGlyGlySerGlyGlyGlySerGlyGlyGlySerGlyThrGln
AspCysSerPheGlnHisSerProIleSerSerAspPheAlaValLysIleArgGluLeuSerAspTyrLeuLeu
GlnAspTyrProValThrValAlaSerAsnLeuTyrValGluGlyGlyGlyGlySerProGlyGluProSerGly
ProIleSerThrIleAsnProSerProProSerLysGluSerHisLysSerProAsnMetAlaThrProLeuGly
ProAlaSerSerLeuProGlnSerPheLeuLeuLysCysLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValLeuArgHisLeuAlaGlnPro SEQ ID NO:741 pMON35765.pep

AlaThrAsnIleSerArgLeuLeuGlnGluThrSerGluGlnLeuValAlaLeuLysProTrpIleThrArgGln
AsnPheSerArgCysLeuGluLeuGlnCysGlnProAspSerSerThrLeuGlyGlyGlySerGlyGlyGlySer
GlyGlyGlySerGlyGlyGlyThrGlnAspCysSerPheGlnHisSerProIleSerSerAspPheAlaValLys
IleArgGluLeuSerAspTyrLeuLeuGlnAspTyrProValThrValAlaSerAsnLeuGlnAspGluLeu
CysGlyGlyLeuTrpArgLeuValLeuAlaGlnArgTrpMetGluArgLeuLysThrValAlaGlySerLysMet
GlnGlyLeuLeuGluArgValAsnThrGluIleHisPheValThrLysCysAlaPheGlnProProProSerCys
LeuArgPheValGlnTyrValGluGlyGlyGlyGlySerProGlyGluProSerGlyProIleSerThrIleAsn
ProSerProProSerLysGluSerHisLysSerProAsnMetAlaThrProLeuGlyProAlaSerSerLeuPro
GlnSerPheLeuLeuLysCysLeuGluGlnValArgLysIleGlnGlyAspGlyAlaAlaLeuGlnGluLysLeu
CysAlaThrTyrLysLeuCysHisProGluGluLeuValLeuLeuGlyHisSerLeuGlyIleProTrpAlaPro
LeuSerSerCysProSerGlnAlaLeuGlnLeuAlaGlyCysLeuSerGlnLeuHisSerGlyLeuPheLeuTyr
GlnGlyLeuLeuGlnAlaLeuGluGlyIleSerProGluLeuGlyProThrLeuAspThrLeuGlnLeuAspVal
AlaAspPheAlaThrThrIleTrpGlnGlnMetGluGluLeuGlyMetAlaProAlaLeuGlnProThrGlnGly

TABLE 3-continued

PROTEIN SEQUENCES

AlaMetProAlaPheAlaSerAlaPheGlnArgArgAlaGlyGlyValLeuValAlaSerHisLeuGlnSerPhe
LeuGluValSerTyrArgValLeuArgHisLeuAlaGlnPro SEQ ID NO:742 pMON35766.pep/pMON32190.pep/pMON40001.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAlaSerAsnLeuGlnTyrValGluGlyGlyGlyGlySerProGlyGlyGlySerGly
GlyGlySerAsnMetAlaThrProLeuGlyProAlaSerSerLeuProGlnSerPheLeuLeuLysSerLeuGlu
GlnValArgLysIleGlnGlyAspGlyAlaAlaLeuGlnGluLysCysAlaThrTyrLysLeuCysHisPro
GluGluLeuValLeuLeuGlyHisSerLeuGlyIleProTrpAlaProLeuSerSerCysProSerGlnAlaLeu
GlnLeuAlaGlyCysLeuSerGlnLeuHisSerGlyLeuPheLeuTyrGlnGlyLeuLeuGlnAlaLeuGluGly
IleSerProGluLeuGlyProThrLeuAspThrLeuGlnLeuAspValAlaAspPheAlaThrThrIleTrpGln
GlnMetGluGluLeuGlyMetAlaProAlaLeuGlnProThrGlnGlyAlaMetProAlaPheAlaSerAlaPhe
GlnArgArgAlaGlyGlyValLeuValAlaSerHisLeuGlnSerPheLeuGluValSerTyrArgValLeuArg
HisLeuAlaGlnPro SEQ ID NO:743 pMON35768.pep

AlaGlnAspGluGluLeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheValThrLysCysAlaPhe
GlnProProProSerCysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCysGlnProAspSerSer
ThrLeuGlyGlyGlySerGlyGlyGlySerGlyGlyGlySerGlyGlyGlySerGlyGlyGlySerGlyThrGln
AspCysSerPheGlnHisSerProIleSerSerAspSerAlaValLysIleArgGluLeuSerAspTyrLeuLeu
GlnAspTyrProValThrValAlaSerAsnLeuTyrValGluGlyGlyGlySerProGlyGluProSerGly
ProIleSerThrIleAsnProSerProProSerLysGluSerHisLysSerProAsnMetAlaThrProLeuGly
ProAlaSerSerLeuProGlnSerPheLeuLeuLysCysLeuGluLeuValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValLeuArgHisLeuAlaGlnPro SEQ ID NO:744 pMON35770.pep

AlaLeuCysGlyGlyLeuTrpArgLeuValLeuAlaGlnArgTrpMetGluArgLeuLysThrValAlaGlySer
LysMetGlnGlyLeuLeuGluArgValAsnThrGluIleHisPheValThrLysTyrAlaPheGlnProProPro
SerCysLeuArgPheValGlnThrAsnIleSerArgLeuLeuGlnGluThrSerGlnLeuValAlaLeuLys
ProTrpIleThrArgGlnAsnPheSerArgCysLeuGluLeuGlnCysArgProAspSerSerThrLeuGlyGly
GlySerGlyGlyGlySerGlyGlyGlySerGlyGlyGlySerGlyThrGlnAspCysSerPheGlnHisSerPro
IleSerSerAspPheAlaValLysIleArgGluLeuSerAspTyrLeuLeuGlnAspTyrProValThrValAla
SerAsnLeuGlnAspGluGluTyrValGluGlyGlyGlyGlySerProGlyGluProSerGlyProIleSerThr
IleAsnProSerProProSerLysGluSerHisLysSerProAsnMetAlaThrProLeuGlyProAlaSerSer
LeuProGlnSerPheLeuLeuLysCysLeuGluGlnValArgLysIleGlnGlyAspGlyAlaAlaLeuGlnGlu
LysLeuCysAlaThrTyrLysLeuCysHisProGluGluLeuValLeuLeuGlyHisSerLeuGlyIleProTrp
AlaProLeuSerSerCysProSerGlnAlaLeuGlnLeuAlaGlyCysLeuSerGlnLeuHisSerGlyLeuPhe
LeuTyrGlnGlyLeuLeuGlnAlaLeuGluGlyIleSerProGluLeuGlyProThrLeuAspThrLeuGlnLeu
AspValAlaAspPheAlaThrThrIleTrpGlnGlnMetGluGluLeuGlyMetAlaProAlaLeuGlnProThr
GlnGlyAlaMetProAlaPheAlaSerAlaPheGlnArgArgAlaGlyGlyValLeuValAlaSerHisLeuGln
SerPheLeuGluValSerTyrArgValLeuArgHisLeuAlaGlnPro SEQ ID NO:745 pMON35772.pep

AlaSerLysMetGlnGlyLeuLeuGluArgValAsnThrGluIleHisPheValThrLysCysAlaPheGlnPro
ProProSerCysLeuArgPheValGlnThrAsnIleSerArgLeuLeuGlnGluThrSerGluGlnLeuValAla
LeuLysProTrpIleThrArgGlnAsnPhePheArgCysLeuGluLeuGlnCysGlnProAspSerSerThrLeu
GlyGlyGlySerGlyGlyGlySerGlyGlyGlySerGlyGlyGlyThrGlnAspCysSerPheGlnHisSerPro
IleSerSerAspPheAlaValLysIleArgGluLeuSerAspTyrLeuLeuGlnAspTyrProValThrValAla
SerAsnLeuGlnAspGluGluLeuCysGlyGlyLeuTrpArgLeuValLeuAlaGlnArgTrpMetGluArgLeu
LysThrValAlaGlyTyrValGluGlyGlyGlyGlySerProGlyGluProSerGlyProIleSerThrIleAsn
ProSerProProSerLysGluSerHisLysSerProAsnMetAlaThrProLeuGlyProAlaSerSerLeuPro
GlnSerPheLeuLeuLysCysLeuGluGlnValArgLysIleGlnGlyAspGlyAlaAlaLeuGlnGluLysLeu
CysAlaThrTyrLysLeuCysHisProGluGluLeuValLeuLeuGlyHisSerLeuGlyIleProTrpAlaPro
LeuSerSerCysProSerGlnAlaLeuGlnLeuAlaGlyCysLeuSerGlnLeuHisSerGlyLeuPheLeuTyr
GlnGlyLeuLeuGlnAlaLeuGluGlyIleSerProGluLeuGlyProThrLeuAspThrLeuGlnLeuAspVal
AlaAspPheAlaThrThrIleTrpGlnGlnMetGluGluLeuGlyMetAlaProAlaLeuGlnProThrGlnGly
AlaMetProAlaPheAlaSerAlaPheGlnArgArgAlaGlyGlyValLeuValAlaSerHisLeuGlnSerPhe
LeuGluValSerTyrArgValLeuArgHisLeuAlaGlnPro SEQ ID NO:746

TABLE 3-continued

PROTEIN SEQUENCES pMON35773.pep

AlaGlnAspGluGluLeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheValThrLysCysAlaPhe
GlnProProProSerCysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCysGlnProAspSerSer
ThrLeuGlyGlyGlySerGlyGlyGlySerGlyGlyGlySerGlyGlyGlySerGlyGlyGlySerGlyGlyGly
SerGlyGlyGlySerGlyThrGlnAspCysSerPheGlnHisSerProIleSerSerAspPheAlaValLysIle
ArgGluLeuSerAspTyrLeuLeuGlnAspTyrProValThrValAlaSerAsnLeuTyrValGluGlyGlyGly
GlySerProGlyGluProSerGlyProIleSerThrIleAsnProSerProProSerLysGluSerHisLysSer
ProAsnMetAlaThrProLeuGlyProAlaSerSerLeuProGlnSerPheLeuLeuLysCysLeuGluGlnVal
ArgLysIleGlnGlyAspGlyAlaAlaLeuGlnGluLysLeuCysAlaThrTyrLysLeuCysHisProGluGlu
LeuValLeuLeuGlyHisSerLeuGlyIleProTrpAlaProLeuSerSerCysProSerGlnAlaLeuGlnLeu
AlaGlyCysLeuSerGlnLeuHisSerGlyLeuPheLeuTyrGlnGlyLeuLeuGlnAlaLeuGluGlyIleSer
ProGluLeuGlyProThrLeuAspThrLeuGlnLeuAspValAlaAspPheAlaThrThrIleTrpGlnGlnMet
GluGluLeuGlyMetAlaProAlaLeuGlnProThrGlnGlyAlaMetProAlaPheAlaSerAlaPheGlnArg
ArgAlaGlyGlyValLeuValAlaSerHisLeuGlnSerPheLeuGluValSerTyrArgValLeuArgHisLeu
AlaGlnPro SEQ ID NO:747 pMON35777.pep

AlaGlnAspGluGluLeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheValThrLysCysAlaPhe
GlnProProProSerCysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCysGlnProAspSerSer
ThrLeuProProProTrpSerProArgProLeuGlyAlaThrAlaProThrSerProAspCysSerPheGlnHis
SerProIleSerSerAspPheAlaValLysIleArgGluLeuSerAspTyrLeuLeuGlnAspTyrProValThr
ValAlaSerAsnLeuTyrValGluGlyGlyGlyGlySerProGlyGluProSerGlyProIleSerThrIleAsn
ProSerProProSerLysGluSerHisLysSerProAsnMetAlaThrProLeuGlyProAlaSerSerLeuPro
GlnSerPheLeuLeuLysCysLeuGluGlnValArgLysIleGlnGlyAspGlyAlaAlaLeuGlnGluLysLeu
CysAlaThrTyrLysLeuCysHisProGluGluLeuValLeuLeuGlyHisSerLeuGlyIleProTrpAlaPro
LeuSerSerCysProSerGlnAlaLeuGlnLeuAlaGlyCysLeuSerGlnLeuHisSerGlyLeuPheLeuTyr
GlnGlyLeuLeuGlnAlaLeuGluGlyIleSerProGluLeuGlyProThrLeuAspThrLeuGlnLeuAspVal
AlaAspPheAlaThrThrIleTrpGlnGlnMetGluGluLeuGlyMetAlaProAlaLeuGlnProThrGlnGly
AlaMetProAlaPheAlaSerAlaPheGlnArgArgAlaGlyGlyValLeuValAlaSerHisLeuGlnSerPhe
LeuGluValSerTyrArgValLeuArgHisLeuAlaGlnPro SEQ ID NO:748 pMON35778.pep

AlaGlnAspGluGluLeuCysGlyGlyLeuTrpArgLeuValLeuAlaGlnArgTrpMetGluArgLeuLysThr
ValAlaGlySerLysMetGlnGlyLeuLeuGluArgValAsnThrGluIleHisPheValThrLysCysAlaPhe
GlnProProProSerCysLeuArgPheValGlnThrAsnIleSerArgLeuLeuGlnGluThrSerGluGlnLeu
ValAlaLeuLysProTrpIleThrArgGlnAsnPheSerArgCysLeuGluLeuGlnCysGlnProAspSerSer
ThrLeuProProProTrpSerProArgProLeuGlyAlaThrAlaProThrAlaGlyGlnProProLeuThrGln
AspCysSerPheGlnHisSerProIleSerSerAspPheAlaValLysIleArgGluLeuSerAspTyrLeuLeu
GlnAspTyrProValThrValAlaSerAsnLeuTyrValGluGlyGlyGlyGlySerProGlyGluProSerGly
ProIleSerThrIleAsnProSerProProSerLysGluSerHisLysSerProAsnMetAlaThrProLeuGly
ProAlaSerSerLeuProGlnSerPheLeuLeuLysCysLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValLeuArgHisLeuAlaGlnPro SEQ ID NO:749 pMON35779.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyGlyGlySer
GlyGlyGlySerGlyThrGlnAspCysSerPheGlnHisSerProIleSerSerAspPheAlaValLysIleArg
GluLeuSerAspTyrLeuLeuGlnAspTyrProValThrValAlaSerAsnLeuGlnTyrValGluGlyGlyGly
GlySerProGlyGluProSerGlyProIleSerThrIleAsnProSerProProSerLysGluSerHisLysSer
ProAsnMetAlaThrProLeuGlyProAlaSerSerLeuProGlnSerPheLeuLeuLysCysLeuGluGlnVal
ArgLysIleGlnGlyAspGlyAlaAlaLeuGlnGluLysLeuCysAlaThrTyrLysLeuCysHisProGluGlu
LeuValLeuLeuGlyHisSerLeuGlyIleProTrpAlaProLeuSerSerCysProSerGlnAlaLeuGlnLeu
AlaGlyCysLeuSerGlnLeuHisSerGlyLeuPheLeuTyrGlnGlyLeuLeuGlnAlaLeuGluGlyIleSer
ProGluLeuGlyProThrLeuAspThrLeuGlnLeuAspValAlaAspPheAlaThrThrIleTrpGlnGlnMet
GluGluLeuGlyMetAlaProAlaLeuGlnProThrGlnGlyAlaMetProAlaPheAlaSerAlaPheGlnArg
ArgAlaGlyGlyValLeuValAlaSerHisLeuGlnSerPheLeuGluValSerTyrArgValLeuArgHisLeu
AlaGlnPro SEQ ID NO:750

TABLE 3-continued

PROTEIN SEQUENCES pMON35780.pep

AlaAspGluGluLeuCysGlyGlyLeuTrpArgLeuValLeuAlaGlnArgTrpMetGluArgProLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyGlyGlySer
GlyGlyGlySerGlyThrGlnAspCysSerPheGlnHisSerProIleSerSerAspPheAlaValLysIleArg
GluLeuSerAspTyrLeuLeuGlnAspTyrProValThrValAlaSerAsnLeuGlnTyrValGluGlyGlyGly
GlySerProGlyGluProSerGlyProIleSerThrIleAsnProSerProProSerLysGluSerHisLysSer
ProAsnMetAlaThrProLeuGlyProAlaSerSerLeuProGlnSerPheLeuLeuLysCysLeuGluGlnVal
ArgLysIleGlnGlyAspGlyAlaAlaLeuGlnGluLysLeuCysAlaThrTyrLysLeuCysHisProGluGlu
LeuValLeuLeuGlyHisSerLeuGlyIleProTrpAlaProLeuSerSerCysProSerGlnAlaLeuGlnLeu
AlaGlyCysLeuSerGlnLeuHisSerGlyLeuPheLeuTyrGlnGlyLeuLeuGlnAlaLeuGluGlyIleSer
ProGluLeuGlyProThrLeuAspThrLeuGlnLeuAspValAlaAspPheAlaThrThrIleTrpGlnGlnMet
GluGluLeuGlyMetAlaProAlaLeuGlnProThrGlnGlyAlaMetProAlaPheAlaSerAlaPheGlnArg
ArgAlaGlyGlyValLeuValAlaSerHisLeuGlnSerPheLeuGluValSerTyrArgValLeuArgHisLeu
AlaGlnPro SEQ ID NO:751 pMON35782.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuProProProTrpSerProArgProLeuGlyAlaThrAlaProThrAlaGlyGlnProProLeuThrGlnAsp
CysSerPheGlnHisSerProIleSerSerAspPheAlaValLysIleArgGluLeuSerAspTyrLeuLeuGln
AspTyrProValThrValAlaSerAsnLeuGlnTyrValGluGlyGlyGlyThrProGlyGluProSerGly
ProIleSerThrIleAsnProSerProProSerLysGluSerHisLysSerProAsnMetAlaThrProLeuGly
ProAlaSerSerLeuProGlnSerPheLeuLeuLysCysLeuGluGlnValArgLysIleGlnGlyAspGlyAla
AlaLeuGlnGluLysLeuCysAlaThrTyrLysLeuCysHisProGluGluLeuValLeuLeuGlyHisSerLeu
GlyIleProTrpAlaProLeuSerSerCysProSerGlnAlaLeuGlnLeuAlaGlyCysLeuSerGlnLeuHis
SerGlyLeuPheLeuTyrGlnGlyLeuLeuGlnAlaLeuGluGlyIleSerProGluLeuGlyProThrLeuAsp
ThrLeuGlnLeuAspValAlaAspPheAlaThrThrIleTrpGlnGlnMetGluGluLeuGlyMetAlaProAla
LeuGlnProThrGlnGlyAlaMetProAlaPheAlaSerAlaPheGlnArgArgAlaGlyGlyValLeuValAla
SerHisLeuGlnSerPheLeuGluValSerTyrArgValLeuArgHisLeuAlaGlnPro SEQ ID NO:752 pMON39908.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProValGluThrVal
PheHisArgValSerGlnAspGlyLeuAspLeuLeuThrSerThrGlnAspCysSerPheGlnHisSerProIle
SerSerAspPheAlaValLysIleArgGluLeuSerAspTyrLeuLeuGlnAspTyrProValThrValAlaSer
AsnLeuGlnTyrValGluGlyGlyGlyGlySerProGlyGlyGlySerGlyGlyGlySerAsnMetAlaThrPro
LeuGlyProAlaSerSerLeuProGlnSerPheLeuLeuLysSerLeuGluGlnValArgLysIleGlnGlyAsp
GlyAlaAlaLeuGlnGluLysLeuCysAlaThrAsnLysLeuCysHisProGluGluLeuValLeuLeuGlyHis
SerLeuGlyIleProTrpAlaProLeuSerSerCysProSerGlnAlaLeuGlnLeuAlaGlyCysLeuSerGln
LeuHisSerGlyLeuPheLeuTyrGlnGlyLeuLeuGlnAlaLeuGluGlyIleSerProGluLeuGlyProThr
LeuAspThrLeuGlnLeuAspValAlaAspPheAlaThrThrIleTrpGlnGlnMetGluGluLeuGlyMetAla
ProAlaLeuGlnProThrGlnGlyAlaMetProAlaPheAlaSerAlaPheGlnArgArgAlaGlyGlyValLeu
ValAlaSerHisLeuGlnSerPheLeuGluValSerTyrArgValLeuArgHisLeuAlaGlnPro SEQ ID NO:753 pMON32275.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuTyrValGluGlyGlyGlySerProGlyGluProSerGlyProIleSerThrIleAsnProSerProPro
SerLysGluSerHisLysSerProAsnMetAlaThrProLeuGlyProAlaSerSerLeuProGlnSerPheLeu
LeuLysSerLeuGluGlnValArgLysIleGlnGlyAspGlyAlaAlaLeuGlnGluLysLeuCysAlaThrTyr
LysLeuCysHisProGluGluLeuValLeuLeuGlyHisSerLeuGlyIleProTrpAlaProLeuSerSerCys
ProSerGlnAlaLeuGlnLeuAlaGlyCysLeuSerGlnLeuHisSerGlyLeuPheLeuTyrGlnGlyLeuLeu
GlnAlaLeuGluGlyIleSerProGluLeuGlyProThrLeuAspThrLeuGlnLeuAspValAlaAspPheAla
ThrThrIleTrpGlnGlnMetGluGluLeuGlyMetAlaProAlaLeuGlnProThrGlnGlyAlaMetProAla
PheAlaSerAlaPheGlnArgArgAlaGlyGlyValLeuValAlaSerHisLeuGlnSerPheLeuGluValSer
TyrArgValLeuArgHisLeuAlaGlnProTyrValGluGlyGlyGlySerProGlyGluProSerGlyPro
IleSerThrIleAsnProSerProProSerLysGluSerHisLysSerProAsnMetAlaThrGlnAspCysSer
PheGlnHisSerProIleSerSerAspPheAlaValLysIleArgGluLeuSerAspTyrLeuLeuGlnAspTyr
ProValThrValAlaSerAsnLeuGln SEQ ID NO:754 pMON35781.pep

AlaThrGlnAspCysSerPheGlnHisSerProIleSerSerAspPheAlaValLysIleArgGluLeuSerAsp
TyrLeuLeuGlnAspTyrProValThrValAlaSerAsnLeuGlnGluProLysSerProAspThrHisThrSer

TABLE 3-continued

PROTEIN SEQUENCES

ProProSerProThrProLeuGlyProAlaSerSerLeuProGlnSerPheLeuLeuLysSerLeuGluGlnVal
ArgLysIleGlnGlyAspGlyAlaAlaLeuGlnGluLysLeuCysAlaThrTyrLysLeuCysHisProGluGlu
LeuValLeuLeuGlyHisSerLeuGlyIleProTrpAlaProLeuSerSerCysProSerGlnAlaLeuGlnLeu
AlaGlyCysLeuSerGlnLeuHisSerGlyLeuPheLeuTyrGlnGlyLeuLeuGlnAlaLeuGluGlyIleSer
ProGluLeuGlyProThrLeuAspThrLeuGlnLeuAspValAlaAspPheAlaThrThrIleTrpGlnGlnMet
GluGluLeuGlyMetAlaProAlaLeuGlnProThrGlnGlyAlaMetProAlaPheAlaSerAlaPheGlnArg
ArgAlaGlyGlyValLeuValAlaSerHisLeuGlnSerPheLeuGluValSerTyrArgValLeuArgHisLeu
AlaGlnProSerAlaGluProLysSerProAspThrHisThrSerProProSerProGlySerAsnLeuGlnAsp
GluGluLeuCysGlyGlyLeuTrpArgLeuValLeuAlaGlnArgTrpMetGluArgLeuLysThrValAlaGly
SerLysMetGlnGlyLeuLeuGluArgValAsnThrGluIleHisPheValThrLysCysAlaPheGlnProPro
ProSerCysLeuArgPheValGlnThrAsnIleSerArgLeuLeuGlnGluThrSerGluGlnLeuValAlaLeu
LysProTrpIleThrArgGlnAsnPheSerArgCysLeuGluLeuGlnCysGlnProAspSerSerThrLeu
SEQ ID NO:755 pMON35783.pep

AlaThrGlnAspCysSerPheGlnHisSerProIleSerSerAspPheAlaValLysIleArgGluLeuSerAsp
TyrLeuLeuGlnAspTyrProValThrValAlaSerAsnLeuGlnAspGluLeuCysGlyGlyLeuTrpArg
LeuValLeuAlaGlnArgTrpMetGluArgLeuLysThrValAlaGlySerLysMetGlnGlyLeuGlnGlyArg
ValAsnThrGluIleHisPheValThrLysCysAlaPheProLysSerProAspThrHisThrSerProProSer
ProGlyThrProLeuGlyProAlaSerSerLeuProGlnSerPheLeuLeuLysSerLeuGluGlnValArgLys
IleGlnGlyAspGlyAlaAlaLeuGlnGluLysLeuCysAlaTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
SerAlaGluProLysSerProAspThrHisThrSerProProSerProGlyLysAlaPheGlnProProProSer
CysLeuArgPheValGlnThrAsnIleSerArgLeuLeuGlnGluThrSerGluGlnLeuValAlaLeuLysPro
TrpIleThrArgGlnAsnPheSerArgCysLeuGluLeuGlnCysGlnProAspSerSerThrLeu SEQ ID NO:756 pMON32276.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysSerAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
SerSerPheGlnHisSerProIleSerSerAspPheAlaValLysIleArgGluLeuSerAspTyrLeuLeuGln
AspTyrProValThrValAlaSerAsnLeuGlnTyrValGluGlyGlyGlyGlySerProGlyGlyGlySerGly
GlyGlySerAsnMetAlaThrProLeuGlyProAlaSerSerLeuProGlnSerPheLeuLeuLysSerLeuGlu
GlnValArgLysIleGlnGlyAspGlyAlaAlaLeuGlnGluLysLeuCysAlaThrAsnLysLeuCysHisPro
GluGluLeuValLeuLeuGlyHisSerLeuGlyIleProTrpAlaProLeuSerSerCysProSerGlnAlaLeu
GlnLeuAlaGlyCysLeuSerGlnLeuHisSerGlyLeuPheLeuTyrGlnGlyLeuLeuGlnAlaLeuGluGly
IleSerProGluLeuGlyProThrLeuAspThrLeuGlnLeuAspValAlaAspPheAlaThrThrIleTrpGln
GlnMetGluGluLeuGlyMetAlaProAlaLeuGlnProThrGlnGlyAlaMetProAlaPheAlaSerAlaPhe
GlnArgArgAlaGlyGlyValLeuValAlaSerHisLeuGlnSerPheLeuGluValSerTyrArgValLeuArg
HisLeuAlaGlnPro SEQ ID NO:757 pMON32277.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer
LysGluSerHisLysSerProAsnMetLeuAspGluGluLeuCysGlyGlyLeuTrpArgLeuValLeuAlaGln
ArgTrpMetGluArgLeuLysThrValAlaGlySerLysMetGlnGlyLeuLeuGluArgValAsnThrGluIle
HisPheValThrLysSerAlaPheGlnProProProSerCysLeuArgPheValGlnThrAsnIleSerArgLeu
LeuGlnGluThrSerGluGlnLeuValAlaLeuLysProTrpIleThrArgGlnAsnPheSerArgCysLeuGlu
LeuGlnCysGlnProAspSerSerThrLeuGlyGlyGlySerGlyGlyGlySerGlyGlyGlySerGlyGlyGly
SerGlyGlyGlySerGlyThrGlnAspSerSerPheGlnHisSerProIleSerSerAspPheAlaValLysIle
ArgGluLeuSerAspTyrLeuLeuGlnAspTyrProValThrValAlaSerAsnLeuGln SEQ ID NO:758 pMON32278.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAlaSerAsnLeuGlnTyrValGluGlyGlyGlyGlySerProGlyGlyGlySerGly
GlyGlySerAsnMetAlaThrProLeuGlyProAlaSerSerLeuProGlnSerPheLeuLeuLysSerLeuGlu

TABLE 3-continued

PROTEIN SEQUENCES

GlnValArgLysIleGlnGlyAspGlyAlaAlaLeuGlnGluLysLeuCysAlaThrAsnLysLeuCysHisPro
GluGluLeuValLeuLeuGlyHisSerLeuGlyIleProTrpAlaProLeuSerSerCysProSerGlnAlaLeu
GlnLeuAlaGlyCysLeuSerGlnLeuHisSerGlyLeuPheLeuTyrGlnGlyLeuLeuGlnAlaLeuGluGly
IleSerProGluLeuGlyProThrLeuAspThrLeuGlnLeuAspValAlaAspPheAlaThrThrIleTrpGln
GlnMetGluGluLeuGlyMetAlaProAlaLeuGlnProThrGlnGlyAlaMetProAlaPheAlaSerAlaPhe
GlnArgArgAlaGlyGlyValLeuValAlaSerHisLeuGlnSerPheLeuGluValSerTyrArgValLeuArg
HisLeuAlaGlnPro SEQ ID NO:759 pMON32279.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer
LysGluSerHisLysSerProAsnMetAlaAspGluGluLeuCysGlyGlyLeuTrpArgLeuValLeuAlaGln
ArgTrpMetGluArgLeuLysThrValAlaGlySerLysMetGlnGlyLeuLeuGluArgValAsnThrGluIle
HisPheValThrLysCysAlaPheGlnProProProSerSerLeuArgPheValGlnThrAsnIleSerArgLeu
LeuGlnGluThrSerGluGlnLeuValAlaLeuLysProTrpIleThrArgGlnAsnPheSerArgCysLeuGlu
LeuSerGlnProAspSerSerThrLeuGlyGlyGlySerGlyGlyGlySerGlyGlyGlySerGlyGlyGly
SerGlyGlyGlySerGlyThrGlnAspCysSerPheGlnHisSerProIleSerSerAspPheAlaValLysIle
ArgGluLeuSerAspTyrLeuLeuGlnAspTyrProValThrValAlaSerAsnLeuGln SEQ ID NO:760 pMON35790.pep

AlaThrGlnAspSerSerPheGlnHisSerProIleSerSerAspPheAlaValLysIleArgGluLeuSerAsp
TyrLeuLeuGlnAspTyrProValThrValAlaSerAsnLeuGlnAspGluGluLeuCysGlyGlyLeuTrpArg
LeuValLeuAlaGlnArgTrpMetGluArgLeuLysThrValAlaGlySerLysMetGlnGlyLeuLeuGluArg
ValAsnThrGluIleHisPheValThrLysSerAlaPheGlnProProProSerCysLeuArgPheValGlnThr
AsnIleSerArgLeuLeuGlnGluThrSerGluGlnLeuValAlaLeuLysProTrpIleThrArgGlnAsnPhe
SerArgCysLeuGluLeuGlnCysGlnProAspSerSerThrLeuTyrValGluGlyGlyGlyGlySerProGly
GlyGlySerGlyGlyGlySerAsnMetAlaThrProLeuGlyProAlaSerSerLeuProGlnSerPheLeuLeu
LysSerLeuGluGlnValArgLysIleGlnGlyAspGlyAlaAlaLeuGlnGluLysLeuCysAlaThrAsnLys
LeuCysHisProGluGluLeuValLeuLeuGlyHisSerLeuGlyIleProTrpAlaProLeuSerSerCysPro
SerGlnAlaLeuGlnLeuAlaGlyCysLeuSerGlnLeuHisSerGlyLeuPheLeuTyrGlnGlyLeuLeuGln
AlaLeuGluGlyIleSerProGluLeuGlyProThrLeuAspThrLeuGlnLeuAspValAlaAspPheAlaThr
ThrIleTrpGlnGlnMetGluGluLeuGlyMetAlaProAlaLeuGlnProThrGlnGlyAlaMetProAlaPhe
AlaSerAlaPheGlnArgArgAlaGlyGlyValLeuValAlaSerHisLeuGlnSerPheLeuGluValSerTyr
ArgValLeuArgHisLeuAlaGlnPro SEQ ID NO:761 pMON35791.pep

AlaThrGlnAspCysSerPheGlnHisSerProIleSerSerAspPheAlaValLysIleArgGluLeuSerAsp
TyrLeuLeuGlnAspTyrProValThrValAlaSerAsnLeuGlnAspGluGluLeuCysGlyGlyLeuTrpArg
LeuValLeuAlaGlnArgTrpMetGluArgLeuLysThrValAlaGlySerLysMetGlnGlyLeuLeuGluArg
ValAsnThrGluIleHisPheValThrLysCysAlaPheGlnProProProSerSerLeuArgPheValGlnThr
AsnIleSerArgLeuLeuGlnGluThrSerGluGlnLeuValAlaLeuLysProTrpIleThrArgGlnAsnPhe
SerArgCysLeuGluLeuGlnSerGlnProAspSerSerThrLeuTyrValGluGlyGlyGlyGlySerProGly
GlyGlySerGlyGlyGlySerAsnMetAlaThrProLeuGlyProAlaSerSerLeuProGlnSerPheLeuLeu
LysSerLeuGluGlnValArgLysIleGlnGlyAspGlyAlaAlaLeuGlnGluLysLeuCysAlaThrAsnLys
LeuCysHisProGluGluLeuValLeuLeuGlyHisSerLeuGlyIleProTrpAlaProLeuSerSerCysPro
SerGlnAlaLeuGlnLeuAlaGlyCysLeuSerGlnLeuHisSerGlyLeuPheLeuTyrGlnGlyLeuLeuGln
AlaLeuGluGlyIleSerProGluLeuGlyProThrLeuAspThrLeuGlnLeuAspValAlaAspPheAlaThr
ThrIleTrpGlnGlnMetGluGluLeuGlyMetAlaProAlaLeuGlnProThrGlnGlyAlaMetProAlaPhe
AlaSerAlaPheGlnArgArgAlaGlyGlyValLeuValAlaSerHisLeuGlnSerPheLeuGluValSerTyr
ArgValLeuArgHisLeuAlaGlnPro SEQ ID NO:762 pMON35792.pep

AlaThrGlnAspCysSerPheGlnHisSerProIleSerSerAspPheAlaValLysIleArgGluLeuSerAsp
TyrLeuLeuGlnAspTyrProValThrValAlaSerAsnLeuGlnAspGluGluLeuCysGlyGlyLeuTrpArg
LeuValLeuAlaGlnArgTrpMetGluArgLeuLysThrValAlaGlySerLysMetGlnGlyLeuLeuGluArg
ValAsnThrGluIleHisPheValThrLysCysAlaPheGlnProProProSerCysLeuArgPheValGlnThr
AsnIleSerArgLeuLeuGlnGluThrSerGluGlnLeuValAlaLeuLysProTrpIleThrArgGlnAsnPhe
SerArgCysLeuGluLeuGlnTyrValGluGlyGlyGlyGlySerProGlyGlyGlySerGlyGlyGlySerAsn
MetAlaThrProLeuGlyProAlaSerSerLeuProGlnSerPheLeuLeuLysSerLeuGluGlnValArgLys
IleGlnGlyAspGlyAlaAlaLeuGlnGluLysLeuCysAlaThrAsnLysLeuCysHisProGluGluLeuVal
LeuLeuGlyHisSerLeuGlyIleProTrpAlaProLeuSerSerCysProSerGlnAlaLeuGlnLeuAlaGly
CysLeuSerGlnLeuHisSerGlyLeuPheLeuTyrGlnGlyLeuLeuGlnAlaLeuGluGlyIleSerProGlu
LeuGlyProThrLeuAspThrLeuGlnLeuAspValAlaAspPheAlaThrThrIleTrpGlnGlnMetGluGlu
LeuGlyMetAlaProAlaLeuGlnProThrGlnGlyAlaMetProAlaPheAlaSerAlaPheGlnArgArgAla
GlyGlyValLeuValAlaSerHisLeuGlnSerPheLeuGluValSerTyrArgValLeuArgHisLeuAlaGln
Pro SEQ ID NO:763

TABLE 3-continued

PROTEIN SEQUENCES pMON39905.pep

AlaThrGlnAspCysSerPheGlnHisSerProIleSerSerAspPheAlaValLysIleArgGluLeuSerAsp
TyrLeuLeuGlnAspTyrProValThrValAlaSerAsnLeuGlnAspGluGluLeuCysGlyGlyLeuTrpArg
LeuValLeuAlaGlnArgTrpMetGluArgLeuLysThrValAlaGlySerLysMetGlnGlyLeuLeuGluArg
ValAsnThrGluIleHisPheValThrLysCysAlaPheGlnProProProSerCysLeuArgPheValGlnThr
AsnIleSerArgLeuLeuGlnGluThrSerGluGlnLeuValAlaLeuLysProTrpIleThrArgGlnAsnPhe
SerArgCysLeuGluLeuGlnSerGlnProAspSerSerThrLeuTyrValGluGlyGlyGlyGlySerProGly
GlyGlySerGlyGlyGlySerAsnMetAlaThrProLeuGlyProAlaSerSerLeuProGlnSerPheLeuLeu
LysSerLeuGluGlnValArgLysIleGlnGlyAspGlyAlaAlaLeuGlnGluLysLeuCysAlaThrTyrLys
LeuCysHisProGluGluLeuValLeuLeuGlyHisSerLeuGlyIleProTrpAlaProLeuSerSerCysPro
SerGlnAlaLeuGlnLeuAlaGlyCysLeuSerGlnLeuHisSerGlyLeuPheLeuTyrGlnGlyLeuLeuGln
AlaLeuGluGlyIleSerProGluLeuGlyProThrLeuAspThrLeuGlnLeuAspValAlaAspPheAlaThr
ThrIleTrpGlnGlnMetGluGluLeuGlyMetAlaProAlaLeuGlnProThrGlnGlyAlaMetProAlaPhe
AlaSerAlaPheGlnArgArgAlaGlyGlyValLeuValAlaSerHisLeuGlnSerPheLeuGluValSerTyr
ArgValLeuArgHisLeuAlaGlnPro SEQ ID NO:764 pMON39906.pep

AlaThrGlnAspCysSerPheGlnHisSerProIleSerSerAspPheAlaValLysIleArgGluLeuSerAsp
TyrLeuLeuGlnAspTyrProValThrValAlaSerAsnLeuGlnAspGluGluLeuCysGlyGlyLeuTrpArg
LeuValLeuAlaGlnArgTrpMetGluArgLeuLysThrValAlaGlySerLysMetGlnGlyLeuLeuGluArg
ValAsnThrGluIleHisPheValThrLysCysAlaPheGlnProProProSerCysLeuArgPheValGlnThr
AsnIleSerArgLeuLeuGlnGluThrSerGluGlnLeuValAlaLeuLysProTrpIleThrArgGlnAsnPhe
SerArgArgLeuGluLeuGlnSerGlnProAspSerSerThrLeuTyrValGluGlyGlyGlyGlySerProGly
GlyGlySerGlyGlyGlySerAsnMetAlaThrProLeuGlyProAlaSerSerLeuProGlnSerPheLeuLeu
LysSerLeuGluGlnValArgLysIleGlnGlyAspGlyAlaAlaLeuGlnGluLysLeuCysAlaThrTyrLys
LeuCysHisProGluGluLeuValLeuLeuGlyHisSerLeuGlyIleProTrpAlaProLeuSerSerCysPro
SerGlnAlaLeuGlnLeuAlaGlyCysLeuSerGlnLeuHisSerGlyLeuPheLeuTyrGlnGlyLeuLeuGln
AlaLeuGluGlyIleSerProGluLeuGlyProThrLeuAspThrLeuGlnLeuAspValAlaAspPheAlaThr
ThrIleTrpGlnGlnMetGluGluLeuGlyMetAlaProAlaLeuGlnProThrGlnGlyAlaMetProAlaPhe
AlaSerAlaPheGlnArgArgAlaGlyGlyValLeuValAlaSerHisLeuGlnSerPheLeuGluValSerTyr
ArgValLeuArgHisLeuAlaGlnPr SEQ ID NO:765 pMON39909.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAlaSerAsnLeuGlnTyrValGlyGlyGlySerProGlyGlyGlySerGly
GlyGlySerAsnMetAlaThrGlnGlyAlaMetProAlaPheAlaSerAlaPheGlnArgArgAlaGlyGlyVal
LeuValAlaSerHisLeuGlnSerPheLeuGluValSerTyrArgValLeuArgHisLeuAlaGlnProSerGly
GlySerGlyGlySerGlnSerPheLeuLeuLysSerLeuGluGlnValArgLysIleGlnGlyAspGlyAlaAla
LeuGlnGluLysLeuCysAlaThrTyrLysLeuCysHisProGluGluLeuValLeuLeuGlyHisSerLeuGly
IleProTrpAlaProLeuSerSerCysProSerGlnAlaLeuGlnLeuAlaGlyCysLeuSerGlnLeuHisSer
GlyLeuPheLeuTyrGlnGlyLeuLeuGlnAlaLeuGluGlyIleSerProGluLeuGlyProThrLeuAspThr
LeuGlnLeuAspValAlaAspPheAlaThrThrIleTrpGlnGlnMetGluGluLeuGlyMetAlaProAlaLeu
GlnPro SEQ ID NO:766 pMON39910.pep

AlaThrGlnGlyAlaMetProAlaPheAlaSerAlaPheGlnArgArgAlaGlyGlyValLeuValAlaSerHis
LeuGlnSerPheLeuGluValSerTyrArgValLeuArgHisLeuAlaGlnProSerGlyGlySerGlyGlySer
GlnSerPheLeuLeuLysSerLeuGluGlnValArgLysIleGlnGlyAspGlyAlaAlaLeuGlnGluLysLeu
CysAlaThrTyrLysLeuCysHisProGluGluLeuValLeuLeuGlyHisSerLeuGlyIleProTrpAlaPro
LeuSerSerCysProSerGlnAlaLeuGlnLeuAlaGlyCysLeuSerGlnLeuHisSerGlyLeuPheLeuTyr
GlnGlyLeuLeuGlnAlaLeuGluGlyIleSerProGluLeuGlyProThrLeuAspThrLeuGlnLeuAspVal
AlaAspPheAlaThrThrIleTrpGlnGlnMetGluGluLeuGlyMetAlaProAlaLeuGlnProTyrValGlu
GlyGlyGlyGlySerProGlyGluProSerGlyProIleSerThrIleAsnProSerProProSerLysGluSer
HisLysSerProAsnMetAlaAspGluGluLeuCysGlyGlyLeuTrpArgLeuValLeuAlaGlnArgTrpMet
GluArgLeuLysThrValAlaGlySerLysMetGlnGlyLeuLeuGluArgValAsnThrGluIleHisPheVal
ThrLysCysAlaPheGlnProProProSerCysLeuArgPheValGlnThrAsnIleSerArgLeuLeuGlnGlu
ThrSerGluGlnLeuValAlaLeuLysProTrpIleThrArgGlnAsnPheSerArgCysLeuGluLeuGlnCys
GlnProAspSerSerThrLeuGlyGlyGlySerGlyGlyGlySerGlyGlyGlySerGlyGlyGlySerGlyGly
GlySerGlyThrGlnAspCysSerPheGlnHisSerProIleSerSerAspPheAlaValLysIleArgGluLeu
SerAspTyrLeuLeuGlnAspTyrProValThrValAlaSerAsnLeuGln SEQ ID NO:767 pMON35727.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlyThrGlnAspCysSerPheGlnHisSer

TABLE 3-continued

PROTEIN SEQUENCES

ProIleSerSerAspPheAlaValLysIleArgGluLeuSerAspTyrLeuLeuGlnAspTyrProValThrVal
AlaSerAsnLeuGlnTyrValGluGlyGlyGlySerProGlyGlnProSerGlyProIleSerThrIleAsn
ProSerProProSerLysGluSerHisLysSerProAsnMetAlaAspGluGluLeuCysGlyGlyLeuTrpArg
LeuValLeuAlaGlnArgTrpMetGluArgLeuLysThrValAlaGlySerLysMetGlnGlyLeuLeuGluArg
ValAsnThrGluIleHisPheValThrLysCysAlaPheGlnProProProSerCysLeuArgPheValGlnThr
AsnIleSerArgLeuLeuGlnGluThrSerGluGlnLeuValAlaLeuLysProTrpIleThrArgGlnAsnPhe
SerArgCysLeuGluLeuGlnCysGlnProAspSerSerThrLeuGlyGlyGlySerGlyGlyGlySerGlyGly
GlySerGlyGlyGlyThrGlnAspCysSerPheGlnHisSerProIleSerSerAspPheAlaValLysIleArg
GluLeuSerAspTyrLeuLeuGlnAspTyrProValThrValAlaSerAsnLeuGln SEQ ID NO:768 pMON32168.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAlaSerAsnLeuGlnTyrValGluGlyGlyGlyGlySerProGlyGluProSerGly
ProIleSerThrIleAsnProSerProProSerLysGluSerHisLysSerProAsnMetAlaThrGlnAspCys
SerPheGlnHisSerProIleSerSerAspPheAlaValLysIleArgGluLeuSerAspTyrLeuLeuGlnAsn
TyrProValThrValAlaSerAsnLeuGlnAspGluGluLeuCysGlyGlyLeuTrpArgLeuValLeuAlaGln
ArgTrpMetGluArgLeuLysThrValAlaGlySerLysMetGlnGlyLeuLeuGluArgValAsnThrGluIle
HisPheValThrLysCysAlaPheGlnProProProSerCysLeuArgPheValGlnThrAsnIleSerArgLeu
LeuGlnGluThrSerGluGlnLeuValAlaLeuLysProTrpIleThrArgGlnAsnPheSerArgCysLeuGlu
LeuGlnCysGlnProAspSerSerThrLeu SEQ ID NO:769 pMON32195.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAlaSerAsnLeuGlnTyrValGluGlyGlyGlyGlySerProGlyGlyGlySerGly
GlyGlySerAsnMetAlaThrProLeuGlyProAlaSerSerLeuProGlnSerPheLeuLeuLysSerLeuGlu
GlnValArgLysIleGlnGlyAspGlyAlaAlaLeuGlnGluLysLeuCysAlaThrTyrLysLeuCysHisPro
GluGluLeuValLeuLeuGlyHisSerLeuGlyIleProTrpAlaProLeuSerSerCysProSerGlnAlaLeu
GlnLeuAlaGlyCysLeuSerGlnLeuHisSerGlyLeuPheLeuTyrGlnGlyLeuLeuGlnAlaLeuGluGly
IleSerProGluLeuGlyProThrLeuAspThrLeuGlnLeuAspValAlaAspPheAlaThrThrIleTrpGln
GlnMetGluGluLeuGlyMetAlaProAlaLeuGlnProThrGlnGlyAlaMetProAlaPheAlaSerAlaPhe
GlnArgArgAlaGlyGlyValLeuValAlaSerHisLeuGlnSerPheLeuGluValSerTyrArgValLeuArg
HisLeuAlaGlnProTyrValGluGlyGlyGlyGlySerProGlyGluProSerGlyProIleSerThrIleAsn
ProSerProProSerLysGluSerHisLysSerProAsnMetAlaAspGluGluLeuCysGlyGlyLeuTrpArg
LeuValLeuAlaGlnArgTrpMetGluArgLeuLysThrValAlaGlySerLysMetGlnGlyLeuLeuGluArg
ValAsnThrGluIleHisPheValThrLysCysAlaPheGlnProProProSerCysLeuArgPheValGlnThr
AsnIleSerArgLeuLeuGlnGluThrSerGluGlnLeuValAlaLeuLysProTrpIleThrArgGlnAsnPhe
SerArgCysLeuGluLeuGlnCysGlnProAspSerSerThrLeuGlyGlyGlySerGlyGlyGlySerGlyGly
GlySerGlyGlyGlySerGlyGlyGlySerGlyThrGlnAspCysSerPheGlnHisSerProIleSerSerAsp
PheAlaValLysIleArgGluLeuSerAspTyrLeuLeuGlnAspTyrProValThrValAlaSerAsnLeuGln
SEQ ID NO:770 pMON32196.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlyGlySerProGlyGluProSerGlyProIleSerThrIleAsnProSerProProSer
LysGluSerHisLysSerProAsnMetAlaAspGluGluLeuCysGlyGlyLeuTrpArgLeuValLeuAlaGln
ArgTrpMetGluArgLeuLysThrValAlaGlySerLysMetGlnGlyLeuLeuGluArgValAsnThrGluIle
HisPheValThrLysCysAlaPheGlnProProProSerCysLeuArgPheValGlnThrAsnIleSerArgLeu
LeuGlnGluThrSerGluGlnLeuValAlaLeuLysProTrpIleThrArgGlnAsnPheSerArgCysLeuGlu
LeuGlnCysGlnProAspSerSerThrLeuGlyGlyGlySerGlyGlyGlySerGlyGlyGlySerGlyGlyGly
SerGlyGlyGlySerGlyThrGlnAspCysSerPheGlnHisSerProIleSerSerAspPheAlaValLysIle
ArgGluLeuSerAspTyrLeuLeuGlnAspTyrProValThrValAlaSerAsnLeuGlnTyrValGluGlyGly
GlyGlySerProGlyGluProSerGlyProIleSerThrIleAsnProSerProProSerLysGluSerHisLys
SerProAsnMetAlaThrGlnAspCysSerPheGlnHisSerProIleSerSerAspPheAlaValLysIleArg
GluLeuSerAspTyrLeuLeuGlnAspTyrProValThrValAlaSerAsnLeuGlnAspGluGluLeuCysGly
GlyLeuTrpArgLeuValLeuAlaGlnArgTrpMetGluArgLeuLysThrValAlaGlySerLysMetGlnGly
LeuLeuGluArgValAsnThrGluIleHisPheValThrLysCysAlaPheGlnProProProSerCysLeuArg
PheValGlnThrAsnIleSerArgLeuLeuGlnGluThrSerGluGlnLeuValAlaLeuLysProTrpIleThr
ArgGlnAsnPheSerArgCysLeuGluLeuGlnCysGlnProAspSerSerThrLeu SEQ ID NO:771

TABLE 3-continued

PROTEIN SEQUENCES pMON32197.pep

AlaThrProLeuGlyProAlaSerSerLeuProGlnSerPheLeuLeuLysSerLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
TyrValGluGlyGlyGlySerProGlyGluProSerGlyProIleSerThrIleAsnProSerProProSer
LysGluSerHisLysSerProAsnMetAlaAspGluGluLeuCysGlyGlyLeuTrpArgLeuValLeuAlaGln
ArgTrpMetGluArgLeuLysThrValAlaGlySerLysMetGlnGlyLeuLeuGluArgValAsnThrGluIle
HisPheValThrLysCysAlaPheGlnProProProSerCysLeuArgPheValGlnThrAsnIleSerArgLeu
LeuGlnGluThrSerGluGlnLeuValAlaLeuLysProTrpIleThrArgGlnAsnPheSerArgCysLeuGlu
LeuGlnCysGlnProAspSerSerThrLeuGlyGlyGlySerGlyGlyGlySerGlyGlyGlySerGlyGlyGly
SerGlyGlyGlySerGlyThrGlnAspCysSerPheGlnHisSerProIleSerSerAspPheAlaValLysIle
ArgGluLeuSerAspTyrLeuLeuGlnAspTyrProValThrValAlaSerAsnLeuGlnTyrValGluGlyGly
GlyGlySerProGlyGluProSerGlyProIleSerThrIleAsnProSerProProSerLysGluSerHisLys
SerProAsnMetAlaAspGluGluLeuCysGlyGlyLeuTrpArgLeuValLeuAlaGlnArgTrpMetGluArg
LeuLysThrValAlaGlySerLysMetGlnGlyLeuLeuGluArgValAsnThrGluIleHisPheValThrLys
CysAlaPheGlnProProProSerCysLeuArgPheValGlnThrAsnIleSerArgLeuLeuGlnGluThrSer
GluGlnLeuValAlaLeuLysProTrpIleThrArgGlnAsnPheSerArgCysLeuGluLeuGlnCysGlnPro
AspSerSerThrLeuGlyGlyGlySerGlyGlyGlySerGlyGlyGlySerGlyGlyGlySerGlyGlySer
GlyThrGlnAspCysSerPheGlnHisSerProIleSerSerAspPheAlaValLysIleArgGluLeuSerAsp
TyrLeuLeuGlnAspTyrProValThrValAlaSerAsnLeuGln SEQ ID NO:772 pMON32206.pep

AlaAsnCysSerIleMetIleAspGluIleIleHisHisLeuLysArgProProAlaProLeuLeuAspProAsn
AsnLeuAsnAspGluAspValSerIleLeuMetAspArgAsnLeuArgLeuProAsnLeuGluSerPheValArg
AlaValLysAsnLeuGluAsnAlaSerGlyIleGluAlaIleLeuArgAsnLeuGlnProCysLeuProSerAla
ThrAlaAlaProSerArgHisProIleIleIleLysAlaGlyAspTrpGlnGluPheArgGluLysLeuThrPhe
TyrLeuValThrLeuGluGlnAlaGlnGluGlnGlnTyrValGluGlyGlyGlyGlySerProGlyGluProSer
GlyProIleSerThrIleAsnProSerProProSerLysGluSerHisLysSerProAsnMetAlaAspGluGlu
LeuCysGlyGlyLeuTrpArgLeuValLeuAlaGlnArgTrpMetGluArgLeuLysThrValAlaGlySerLys
MetGlnGlyLeuLeuGluArgValAsnThrGluIleHisPheValThrLysCysAlaPheGlnProProProSer
CysLeuArgPheValGlnThrAsnIleSerArgLeuLeuGlnGluThrSerGluGlnLeuValAlaLeuLysPro
TrpIleThrArgGlnAsnPheSerArgCysLeuGluLeuGlnCysGlnProAspSerSerThrLeuGlyGlyGly
SerGlyGlyGlySerGlyGlyGlySerGlyGlyGlySerGlyThrGlnAspCysSerPheGln
HisSerProIleSerSerAspPheAlaValLysIleArgGluLeuSerAspTyrLeuLeuGlnAspTyrProVal
ThrValAlaSerAsnLeuGlnTyrValGluGlyGlyGlyGlySerProGlyGluProSerGlyProIleSerThr
IleAsnProSerProProSerLysGluSerHisLysSerProAsnMetAlaAspGluGluLeuCysGlyGlyLeu
TrpArgLeuValLeuAlaGlnArgTrpMetGluArgLeuLysThrValAlaGlySerLysMetGlnGlyLeuLeu
GluArgValAsnThrGluIleHisPheValThrLysCysAlaPheGlnProProProSerCysLeuArgPheVal
GlnThrAsnIleSerArgLeuLeuGlnGluThrSerGluGlnLeuValAlaLeuLysProTrpIleThrArgGln
AsnPheSerArgCysLeuGluLeuGlnCysGlnProAspSerSerThrLeuGlyGlyGlySerGlyGlyGlySer
GlyGlyGlySerGlyGlyGlySerGlyGlyGlySerGlyThrGlnAspCysSerPheGlnHisSerProIleSer
SerAspPheAlaValLysIleArgGluLeuSerAspTyrLeuLeuGlnAspTyrProValThrValAlaSerAsn
LeuGln SEQ ID NO:773 pMON32207.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAlaSerAsnLeuGlnTyrValGluGlyGlyGlyGlySerProGlyGluProSerGly
GlyGlySerAsnMetAlaAspGluGluLeuCysGlyGlyLeuTrpArgLeuValLeuAlaGlnArgTrpMetGlu
ArgLeuLysThrValAlaGlySerLysMetGlnGlyLeuLeuGluArgValAsnThrGluIleHisPheValThr
LysCysAlaPheGlnProProProSerCysLeuArgPheValGlnThrAsnIleSerArgLeuLeuGlnGluThr
SerGluGlnLeuValAlaLeuLysProTrpIleThrArgGlnAsnPheSerArgCysLeuGluLeuGlnCysGln
ProAspSerSerThrLeuGlyGlyGlySerGlyGlyGlySerGlyGlyGlySerGlyGlyGlySerGlyGlyGly
SerGlyThrGlnAspCysSerPheGlnHisSerProIleSerSerAspPheAlaValLysIleArgGluLeuSer
AspTyrLeuLeuGlnAspTyrProValThrValAlaSerAsnLeuGlnTyrValGluGlyGlyGlyGlySerPro
GlyGluProSerGlyProIleSerThrIleAsnProSerProProSerLysGluSerHisLysSerProAsnMet
AlaThrProLeuGlyProAlaSerSerLeuProGlnSerPheLeuLeuLysCysLeuGluGlnValArgLysIle
GlnGlyAspGlyAlaAlaLeuGlnGluLysLeuCysAlaThrTyrLysLeuCysHisProGluGluLeuValLeu
LeuGlyHisSerLeuGlyIleProTrpAlaProLeuSerSerCysProSerGlnAlaLeuGlnLeuAlaGlyCys
LeuSerGlnLeuHisSerGlyLeuPheLeuTyrGlnGlyLeuLeuGlnAlaLeuGluGlyIleSerProGluLeu
GlyProThrLeuAspThrLeuGlnLeuAspValAlaAspPheAlaThrThrIleTrpGlnGlnMetGluGluLeu
GlyMetAlaProAlaLeuGlnProThrGlnGlyAlaMetProAlaPheAlaSerAlaPheGlnArgArgAlaGly
GlyValLeuValAlaSerHisLeuGlnSerPheLeuGluValSerTyrArgValLeuArgHisLeuAlaGlnPro
STPSTPGlySerGluPheGlySer SEQ ID NO:774

TABLE 3-continued

PROTEIN SEQUENCES pMON35728.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlyThrGlnAspCysSerPheGlnHisSer
ProIleSerSerAspPheAlaValLysIleArgGluLeuSerAspTyrLeuLeuGlnAspTyrProValThrVal
AlaSerAsnLeuGlnTyrValGluGlyGlyGlyGlySerProGlyGluProSerGlyProIleSerThrIleAsn
ProSerProProSerLysGluSerHisLysSerProAsnMetAlaAsnCysSerIleMetIleAspGluIleIle
HisHisLeuLysArgProProAsnProLeuLeuAspProAsnAsnLeuAsnSerGluAspMetAspIleLeuMet
GluArgAsnLeuArgThrProAsnLeuLeuAlaPheValArgAlaValLysHisLeuGluAsnAlaSerGlyIle
GluAlaIleLeuArgAsnLeuGlnProCysLeuProSerAlaThrAlaAlaProSerArgHisProIleIleIle
LysAlaGlyAspTrpGlnPheArgGluLysLeuThrPheTyrLeuValThrLeuGluGlnAlaGlnGluGln
GlnTyrValGluGlyGlyGlyGlySerProGlyGluProSerGlyProIleSerThrIleAsnProSerProPro
SerLysGluSerHisLysSerProAsnMetAlaAspGluGluLeuCysGlyGlyLeuTrpArgLeuValLeuAla
GlnArgTrpMetGluArgLeuLysThrValAlaGlySerLysMetGlnGlyLeuLeuGluArgValAsnThrGlu
IleHisPheValThrLysCysAlaPheGlnProProProSerCysLeuArgPheValGlnThrAsnIleSerArg
LeuLeuGlnGluThrSerGluGlnLeuValAlaLeuLysProTrpIleThrArgGlnAsnPheSerArgCysLeu
GluLeuGlnCysGlnProAspSerSerThrLeuGlyGlyGlySerGlyGlyGlySerGlyGlyGlySerGlyGly
GlyThrGlnAspCysSerPheGlnHisSerProIleSerSerAspPheAlaValLysIleArgGluLeuSerAsp
TyrLeuLeuGlnAspTyrProValThrValAlaSerAsnLeuGln SEQ ID NO:775 pMON32183.pep

AlaAspGluGluLeuCysGlyGlyLeuTrpArgLeuValLeuAlaGlnArgTrpMetGluArgLeuLysThrVal
AlaGlySerLysMetGlnGlyLeuLeuGluArgValAsnThrGluIleHisPheValThrLysCysAlaPheGln
ProProProSerCysLeuArgPheValGlnThrAsnIleSerArgLeuLeuGlnGluThrSerGluGlnLeuVal
AlaLeuLysProTrpIleThrArgGlnAsnPheSerArgCysLeuGluLeuGlnCysGlnProAspSerSerThr
LeuGlyGlyGlySerGlyGlyGlySerGlyGlyGlySerGlyGlyGlySerGlyThrGlnAsp
CysSerPheGlnHisSerProIleSerSerAspPheAlaValLysIleArgGluLeuSerAspTyrLeuLeuGln
AspTyrProValThrValAlaSerAsnLeuGlnGluPheLysLeuGluProArgGlyProThrIleLysProCys
ProProCysLysCysProAlaProAsnLeuLeuGlyGlyProSerValPheIlePheProProLysIleLysAsp
ValLeuMetIleSerLeuSerProIleValThrCysValValValAspValSerGluAspAspProAspValGln
IleSerTrpPheValAsnAsnValGluValHisThrAlaGlnThrGlnThrHisArgGluAspTyrAsnSerThr
LeuArgAlaValSerAlaLeuProIleGlnHisGlnAspTrpMetSerGlyLysGluPheLysCysLysValAsn
AsnLysAspLeuProAlaProIleGluArgThrIleSerLysProLysGlySerValArgAlaProGlnValTyr
ValLeuProProProGluGluGluMetThrLysLysGlnValThrLeuThrCysMetValThrAspPheMetPro
GluAspIleTyrValGluTrpThrAsnAsnGlyLysThrGluLeuAsnTyrLysAsnThrGluProValLeuAsp
SerAspGlySerTyrPheMetTyrSerLysLeuArgValGluLysLysAsnTrpValGluArgAsnSerTyrSer
CysSerValValHisGluGlyLeuHisAsnHisHisThrThrLysSerPheSerArgThrProGlyLys SEQ ID NO:776 pMON32184.pep

AlaThrGlnAspCysSerPheGlnHisSerProIleSerSerAspPheAlaValLysIleArgGluLeuSerAsp
TyrLeuLeuGlnAspTyrProValThrValAlaSerAsnLeuGlnAspGluGluLeuCysGlyGlyLeuTrpArg
LeuValLeuAlaGlnArgTrpMetGluArgLeuLysThrValAlaGlySerLysMetGlnGlyLeuLeuGluArg
ValAsnThrGluIleHisPheValThrLysCysAlaPheGlnProProProSerCysLeuArgPheValGlnThr
AsnIleSerArgLeuLeuGlnGluThrSerGluGlnLeuValAlaLeuLysProTrpIleThrArgGlnAsnPhe
SerArgCysLeuGluLeuGlnCysGlnProAspSerSerThrLeuGluPheLysLeuGluProArgGlyProThr
IleLysProCysProProCysLysCysProAlaProAsnLeuLeuGlyGlyProSerValPheIlePheProPro
LysIleLysAspValLeuMetIleSerLeuSerProIleValThrCysValValAspValSerGluAspAsp
ProAspValGlnIleSerTrpPheValAsnAsnValGluValHisThrAlaGlnThrGlnThrHisArgGluAsp
TyrAsnSerThrLeuArgAlaValSerAlaLeuProIleGlnHisGlnAspTrpMetSerGlyLysGluPheLys
CysLysValAsnAsnLysAspLeuProAlaProIleGluArgThrIleSerLysProLysGlySerValArgAla
ProGlnValTyrValLeuProProProGluGluGluMetThrLysLysGlnValThrLeuThrCysMetValThr
AspPheMetProGluAspIleTyrValGluTrpThrAsnAsnGlyLysThrGluLeuAsnTyrLysAsnThrGlu
ProValLeuAspSerAspGlySerTyrPheMetTyrSerLysLeuArgValGluLysLysAsnTrpValGluArg
AsnSerTyrSerCysSerValValHisGluGlyLeuHisAsnHisHisThrThrLysSerPheSerArgThrPro
GlyLys SEQ ID NO:777

The following examples will illustrate the invention in greater detail although it will be understood that the invention is not limited to these specific examples.

EXAMPLE 1
Construction of Parental BHK Expression Vector

A. Removal of AflIII Site from Mammalian Expression Plasmid.

A new mammalian expression vector was constructed to accept NcoI-HindIII or AflIII-HindIII gene fragments in-frame and 3' to the hIL-3 receptor agonist pMON13146 (WO 94/12638) gene and a mouse IgG2b linker fragment. First, the single AflIII site was removed from pMON3934, which is a derivative of pMON3359. pMON3359 is a pUC18-based vector containing a mammalian expression cassette. The cassette includes a herpes simplex viral promoter IE110 (−800 to +120) followed by a modified human IL-3 signal peptide sequence and an SV40 late polyadenylation (poly-A) signal which has been subcloned into the pUC18 polylinker (See Hippenmeyer et al., Bio/Technology, 1993, pp. 1037–1041). The modified human IL-3 signal sequence, which facilitates secretion of gene products outside of the cell, is flanked by a BamHI site on the 5' end and a unique NcoI site on the 3' end. A unique HindIII site is 3' to the NcoI site and 5' to the poly-A sequence. The DNA sequence encoding the signal peptide is shown below (restriction enzyme sites are indicated above). The ATG (methionine) codon within the NcoI site is in-frame with the initiator ATG of the signal peptide (underlined);

BamHI NcoI 5'GGATCCACCATGAGCCGCCTGCCCG-TCCTGCTCCTGCTCCAACTCCTGGTCCGCCCCG-CCATGG (SEQ ID NO:857)

The single AflIII site was removed from pMON3934 by digestion with AflIII followed by filling in the overhangs by addition of a DNA polymerase and nucleotides. The digested DNA fragment was purified via Magic PCR Clean up kit (Promega) and ligated with T4 DNA ligase. The ligation reaction was transformed into DH5α™ and the cells were plated onto LB-agar plus ampicillin. Individual colonies were screened for the loss of the AflIII site by restriction analysis with AflIII and HindIII which results in a single fragment if the AflIII site was removed. The resulting plasmid was designated pMON30275.

B. Transfer of hIL-3 Receptor Agonist pMON13416/IgG2b Cassette into pMON30275.

The NcoI-HindIII fragment (ca. 425 bp) from pMON30245 was ligated to the NcoI-HindIII fragment (ca. 3800 bp) of the pMON30275. pMON30245 (WO 94/12638) contains the gene coding for hIL-3 receptor agonist pMON13416 joined to a mouse IgG2b hinge fragment. Immediately 3' to the IgG2b hinge and 5' to the HindIII site is an AflIII site. Genes can be cloned into the AflIII-HindIII sites as NcoI-HindIII or AflIII-HindIII fragments in frame with the hIL-3 variant pMON13416/IgG2b hinge to create novel chimeras. The NcoI site and the AflIII site have compatible overhangs and will ligate but both recognition sites are lost. The plasmid, pMON30304 containing the DNA sequence of (SEQ ID NO:1), coding for hIL-3 variant pMON13416 joined with a mouse IgG2b hinge region, was a result of this cloning.

EXAMPLE 2
Construction of an Intermediate Plasmid Containing One Copy of the c-mpl Ligand (1–153) Gene of the Dimer Template In order to generate a plasmid DNA with the coding sequence of c-mpl (1–153) ligand followed by a unique EcoRI restriction site, the gene is isolated via reverse transcriptase/polymerase chain reaction (RT/PCR). Human fetal (lot #38130) and adult liver (lot #46018) A+ RNA are obtained from Clontech (Palo Alto, Calif.) for source of c-mpl ligand messenger RNA (mRNA). The first strand cDNA reactions are carried out using a cDNA Cycle™ Kit obtained from Invitrogen (San Diego, Calif.). In the RT reaction, random primers and oligo dT primer are used to generate cDNA from a combination of human and fetal liver mRNA. For amplification of c-mpl ligand gene fragment encoding amino acids 1–153, the RT product serves as the template for PCR with a combination of the primers, Forward primer: c-mplNcoI (SEQ ID NO:317) and Reverse primer: Ecompl. The c-mplNcoI primer anneals to the c-mpl ligand gene (bases #279–311 based on c-mpl ligand sequence from Gene bank accession #L33410 or de Sauvage et al., Nature 369: 533–538 (1994)) and encodes a NcoI restriction enzyme site immediately 5' to the first codon (Ser+1) of c-mpl ligand. The NcoI restriction enzyme site codes for methionine and alanine codons prior to Ser+1 and includes codon degeneracy for the Ala codon and the first four codons (Ser, Pro, Ala, & Pro) of c-mpl ligand. The Ecompl primer anneals to bases #720–737 of. c-mpl ligand and encodes an EcoRI site (GAATTC) in-frame with the c-mpl ligand gene immediately following Arg-153. The EcoRI site creates Glu and Phe codons following Arg-153. The ca. 480 bp PCR product was purified, digested with NcoI and EcoRI and ligated to the NcoI-EcoRI vector fragment of pMON3993 (ca. 4550 bp.). pMON3993 was a derivative of pMON3359 (described in Example 1). The human IL-3 signal peptide sequence, which had been subcloned as a BamHI fragment into the unique BamHI site between the IE110 promoter and poly-A signal, contains an NcoI site at its 3' end and is followed by a unique EcoRI site. The plasmid, pMON26458 containing the DNA sequence of (SEQ ID NO:2), coding for c-mpl ligand amino acids 1–153 (SEQ ID NO:467), was the result of this cloning.

EXAMPLE 3
Construction of the Parental Plasmids Containing the Second Genes of the Dimer Templates For amplification of c-mpl ligand gene fragments starting at amino acid 1 (Ser) with a termination codon following amino acid 153 (Arg), the RT reaction from Example 2 serves as the template for PCR with a combination of the following primers; c-mplNcoI (SEQ ID NO:317) (forward primer) and c-mplHindIII (SEQ ID NO:319) (reverse primer). The c-mplNcoI (SEQ ID NO:317) primer is described in Example 2. The c-mplHindIII (SEQ ID NO:319) primer, which anneals to bases #716–737 of c-mpl ligand, adds both a termination codon and a HindIII restriction enzyme site immediately following the final codon, $Arg^{153}$.

Two types of PCR products are generated from the RT cDNA samples, one with a deletion of the codons for amino acids 112–115 and one without the deletion of these codons. The c-mpl ligand PCR products (ca. 480 bp) are digested with NcoI and HindIII restriction enzymes for transfer to a mammalian expression vector, pMON3934. pMON3934 is digested with NcoI and HindIII (ca. 3800 bp) and will accept the PCR products.

Plasmid, pMON32132 (SEQ ID NO:84), coding for c-mpl ligand amino acids 1–153 (SEQ ID NO:546) was a result of this cloning. Plasmid, pMON32134 (SEQ ID NO:86), coding for c-mpl ligand amino acids 1–153 (SEQ ID NO:548) was a result of this cloning. Plasmid, pMON32133 (SEQ ID NO:85), coding for c-mpl ligand amino acids 1–153 with a deletion of codons 112–115 (Δ112–115) (SEQ ID NO:547) was also a result of this cloning.

EXAMPLE 4
Generation of PCR Dimer Template 5L with a 112–115 Deletion in the Second c-mpl Ligand Gene A PCR template for generating novel forms of c-mpl ligand is constructed by ligating the 3.7 Kbp BstXI/EcoRI fragment of pMON26458 to the 1 Kbp NcoI/BstXI fragment from pMON32133 (containing a deletion of amino acids 112–115) along with the EcoRI/AflIII 5L synthetic oligonucleotide linker 5L-5' (SEQ ID NO:322) and 5L-3' (SEQ ID NO:323).

The EcoRI end of the linker will ligate to the EcoRI end of pMON26458. The AflIII end of the linker will ligate to the NcoI site of pMON32133, and neither restriction site will be retained upon ligation. The BstXI sites of pMON26458 and pMON32133 will ligate as well. Plasmid, pMON28548, is a result of the cloning and contains the DNA sequence of (SEQ ID NO:3) which encodes amino acids 1–153 c-mpl ligand fused via a GluPheGlyGlyAsnMet (SEQ ID NO:783) linker to amino acids 1–153 c-mpl ligand that contains a deletion of amino acids 112–115 (SEQ ID NO:468).

EXAMPLE 5
Generation of PCR Dimer Template 4L

A PCR template for generating novel forms of c-mpl ligand is constructed by ligating the 3.7 Kbp BstXI/EcoRI fragment of pMON26458 to the 1 Kbp NcoI/BstXI fragment from pMON32132 along with the EcoRI/AflIII 4L synthetic oligonucleotide linker 4L-5' (SEQ ID NO:320) and 4L-3' (SEQ ID NO:321).

The EcoRI end of the linker will ligate to the EcoRI end of pMON26458. The AflIII end of the linker will ligate to the NcoI site of pMON32132, and neither restriction site will be retained upon ligation. The BstXI sites of pMON26458 and pMON32132 will ligate as well. The plasmid, pMON28500, is a result of the cloning and contains the DNA sequence of (SEQ ID NO:4) which encodes amino acids 1–153 c-mpl ligand fused via a GluPheGlyAsnMetAla (SEQ ID NO:223) linker (4L) to amino acids 1–153 c-mpl ligand (SEQ ID NO:469).

EXAMPLE 6
Generation of PCR Dimer Template 5L

A PCR template for generating novel forms of c-mpl ligand is constructed by ligating the 3.7 Kbp BstXI/EcoRI fragment of pMON26458 to the 1 Kbp NcoI/BstXI fragment from pMON32132 along with the EcoRI/AflIII 5L synthetic oligonucleotide linker 5L-5' (SEQ ID NO:322) and 5L-3' (SEQ ID NO:323).

The EcoRI end of the linker will ligate to the EcoRI end of pMON26458. The AflIII end of the linker will ligate to the NcoI site of pMON32132, and neither restriction site will be retained upon ligation. The BstXI sites of pMON26458 and pMON32132 will ligate as well. Plasmid, pMON28501 is a result of the cloning and contains the DNA sequence of (SEQ ID NO:4) which encodes amino acids 1–153 c-mpl ligand fused via a GluPheGlyGlyAsnMet (SEQ ID NO:783) linker (5L) to amino acids 1–153 c-mpl ligand (SEQ ID NO:470).

EXAMPLE 7
Generation of PCR Dimer Templates 8L

A PCR template for generating novel forms of c-mpl ligand is constructed by ligating the 3.7 Kbp BstXI/EcoRI fragment of pMON26458 to the 1 Kbp NcoI/BstXI fragment from pMON32134 along with the EcoRI/AflIII 8L synthetic oligonucleotide linker 8L-5' (SEQ ID NO:324) and 8L-3' (SEQ ID NO:325).

The EcoRI end of the linker will ligate to the EcoRI end of pMON26458. The AflIII end of the linker will ligate to the NcoI site of pMON32134, and neither restriction site will be retained upon ligation. The BstXI sites of pMON26458 and pMON32134 will ligate as well. Plasmid, pMON28502 is a result of the cloning which contains the DNA sequence of (SEQ ID NO:6) and encodes amino acids 1–153 c-mpl ligand fused via a GluPheGlyGlyAsnGlyGlyAsnMetAla (SEQ ID NO:224) linker (8L) to amino acids 1–153 c-mpl ligand (SEQ ID NO:471).

EXAMPLES 8–44
Generation of Novel c-mpl Ligand Genes with New N-Terminus and C-Terminus A. PCR Generation of Genes Encoding Novel c-mpl Ligand Receptor Agonists.

Genes encoding novel c-mpl ligand receptor agonists were generated using Method III (Horlick et al., *Prot. Eng.* 5:427–433, 1992). The PCR reactions were carried out using dimer templates, pMONs 28500, 28501, 28502 or 28548 and one of the sets of synthetic primer sets below (The first number refers to the position of the first amino acid in the original sequence. For example, the 31-5' and 31-3' refers to the 5' and 3' oligo primers, receptively, for the sequence beginning at the codon corresponding to residue 31 of the original sequence.).

31-5' (SEQ ID NO:326) and 31-3' (SEQ ID NO:327), 35-5' (SEQ ID NO:328) and 35-3' (SEQ ID NO:329), 39-5' (SEQ ID NO:330) and 39-3' (SEQ ID NO:331), 43-5' (SEQ ID NO:332) and 43-3' (SEQ ID NO:333), 45-5' (SEQ ID NO:334) and 45-3' (SEQ ID NO:335), 49-5' (SEQ ID NO:336) and 49-3' (SEQ ID NO:337), 82-5' (SEQ ID NO:338) and 82-3' (SEQ ID NO:339), 109-5' (SEQ ID NO:340) and 109-3' (SEQ ID NO:341), 115-5' (SEQ ID NO:342) and 115-3' (SEQ ID NO:343), 120-5' (SEQ ID NO:344) and 120-3' (SEQ ID NO:345), 123-5' (SEQ ID NO:346) and 123-3' (SEQ ID NO:347), 126-5' (SEQ ID NO:348) and 126-3' (SEQ ID NO:349).

The templates and oligonucleotide sets used in the PCR reactions are shown in Table 4. The products that were generated were about 480 bp and were purified via Magic PCR Clean up kits (Promega).

B. Subcloning of novel c-mpl receptor agonist gene products into mammalian expression vector for generation of chimeras.

The c-mpl receptor agonist gene PCR products were digested with NcoI and HindIII or AflIII and HindIII restriction enzymes (ca. 470 bp) for transfer to a mammalian expression vector. The expression vector, pMON30304, was digested with NcoI and HindIII (ca. 4200 bp) and accepts the PCR products as NcoI-HindIII or AflIII-HindIII fragments. The restriction digest of the PCR product and the resulting plasmids are shown in Table 4.

TABLE 4

| Example # | PCR template | PCR Product Primer set | PCR Product Restriction Digest | Linker | Resulting Plasmid pMON | Breakpoint in c-mpl ligand |
|---|---|---|---|---|---|---|
| Example 8 | pMON28501 | 31 | NcoI/HindIII | 5L | 28505 | 30–31 |
| Example 9 | pMON28501 | 35 | AflIII/HindIII | 5L | 28506 | 34–35 |
| Example 10 | pMON28501 | 39 | NcoI/HindIII | 5L | 28507 | 38–39 |
| Example 11 | pMON28501 | 43 | NcoI/HindIII | 5L | 28508 | 42–43 |
| Example 12 | pMON28501 | 45 | NcoI/HindIII | 5L | 28509 | 44–45 |
| Example 13 | pMON28501 | 49 | NcoI/HindIII | 5L | 28510 | 48–49 |
| Example 14 | pMON28501 | 82 | NcoI/HindIII | 5L | 28511 | 81–82 |
| Example 15 | pMON28501 | 109 | NcoI/HindIII | 5L | 28512 | 108–109 |
| Example 16 | pMON28501 | 116 | NcoI/HindIII | 5L | 28513 | 115–116 |
| Example 17 | pMON28501 | 120 | NcoI/HindIII | 5L | 28514 | 119–120 |
| Example 18 | pMON28501 | 123 | NcoI/HindIII | 5L | 28515 | 122–123 |

TABLE 4-continued

| Example # | PCR template | PCR Product Primer set | PCR Product Restriction Digest | Linker | Resulting Plasmid pMON | Breakpoint in c-mpl ligand |
|---|---|---|---|---|---|---|
| Example 19 | pMON28501 | 126 | NcoI/HindIII | 5L | 28516 | 125–126 |
| Example 20 | pMON28500 | 31 | NcoI/HindIII | 4L | 28519 | 30–31 |
| Example 21 | pMON28500 | 35 | AflIII/HindIII | 4L | 28520 | 34–35 |
| Example 22 | pMON28500 | 39 | NcoI/HindIII | 4L | 28521 | 38–39 |
| Example 23 | pMON28500 | 43 | NcoI/HindIII | 4L | 28522 | 42–43 |
| Example 24 | pMON28500 | 45 | NcoI/HindIII | 4L | 28523 | 44–45 |
| Example 25 | pMON28500 | 49 | NcoI/HindIII | 4L | 28524 | 48–49 |
| Example 26 | pMON28500 | 82 | NcoI/HindIII | 4L | 28525 | 81–82 |
| Example 27 | pMON28500 | 109 | NcoI/HindIII | 4L | 28526 | 108–109 |
| Example 28 | pMON28500 | 116 | NcoI/HindIII | 4L | 28527 | 115–116 |
| Example 29 | pMON28500 | 120 | NcoI/HindIII | 4L | 28528 | 119–120 |
| Example 30 | pMON28500 | 123 | NcoI/HindIII | 4L | 28529 | 122–123 |
| Example 31 | pMON28500 | 126 | NcoI/HindIII | 4L | 28530 | 125–126 |
| Example 32 | pMON28502 | 31 | NcoI/HindIII | 8L | 28533 | 30–31 |
| Example 33 | pMON28502 | 35 | AflIII/HindIII | 8L | 28534 | 34–35 |
| Example 34 | pMON28502 | 39 | NcoI/HindIII | 8L | 28535 | 38–39 |
| Example 35 | pMON28502 | 43 | NcoI/HindIII | 8L | 28536 | 42–43 |
| Example 36 | pMON28502 | 45 | NcoI/HindIII | 8L | 28537 | 44–45 |
| Example 37 | pMON28502 | 49 | NcoI/HindIII | 8L | 28538 | 48–49 |
| Example 38 | pMON28502 | 82 | NcoI/HindIII | 8L | 28539 | 81–82 |
| Example 39 | pMON28502 | 109 | NcoI/HindIII | 8L | 28540 | 108–109 |
| Example 40 | pMON28502 | 116 | NcoI/HindIII | 8L | 28541 | 115–116 |
| EXAMPLE 41 | pMON28502 | 120 | NcoI/HindIII | 8L | 28542 | 119–120 |
| Example 42 | pMON28502 | 123 | NcoI/HindIII | 8L | 28543 | 122–123 |
| Example 43 | pMON28502 | 126 | NcoI/HindIII | 8L | 28544 | 125–126 |
| Example 44 | pMON28548 | 123 | NcoI/HindIII | 8L | 28545 | 122–123 |

EXAMPLE 45
Construction of pMON15960

Construction of pMON15960, an intermediate plasmid used for constructing plasmids containing DNA sequences encoding G-CSF Ser$^{17}$ with a new N-terminus and C-terminus. Plasmid pACYC177 (Chang, A. C. Y. and Cohen, S. N. *J. Bacteriol.* 134:1141–1156, 1978) DNA was digested with restriction enzymes HindIII and BamHI, resulting in a 3092 base pair HindIII, BamHI fragment. Plasmid, pMON13037 (WO 95/21254), DNA was digested with BglII and FspI, resulting in a 616 base pair BglII, FspI fragment. A second sample of plasmid, pMON13037, DNA was digested with NcoI and HindIII, resulting in a 556 base pair NcoI, HindIII fragment. The synthetic DNA oligonucleotides 1GGGSfor (SEQ ID NO:380) and 1GGGSrev (SEQ ID NO:381) were annealed to each other, and then digested with AflIII and FspI, resulting in a 21 base pair AflIII, FspI fragment. The restriction fragments were ligated, and the ligation reaction mixture was used to transform *E. coli* K-12 strain JM101. Transformant bacteria were selected on ampicillin-containing plates. Plasmid DNA was isolated and analyzed by restriction analysis to confirm the correct insert.

EXAMPLE 46
Construction of pMON15981

Construction of pMON15981, a plasmid containing DNA sequences encoding a multi-functional hematopoietic receptor agonist. Plasmid, pMON15960, DNA was digested with restriction enzyme SmaI and used as template in a PCR reaction using synthetic DNA oligonucleotides 38 stop (SEQ ID NO:369) and 39 start (SEQ ID NO:368) as primers, resulting in the amplification of a DNA fragment of 576 base pairs. The amplified fragment was digested with restriction enzymes HindIII and NcoI, resulting in a HindIII, NcoI fragment of 558 base pairs. Plasmid, pMON13181, DNA was digested with HindIII and AflIII, resulting in a HindIII, AflIII fragment of 4068 base pairs. The restriction fragments were ligated, and the ligation reaction mixture was used to transform *E. coli* K-12 strain JM101. Transformant bacteria were selected on ampicillin-containing plates. Plasmid DNA was isolated, analyzed by restriction analysis, and sequenced to confirm the correct insert. The plasmid, pMON15981, contains the DNA sequence of (SEQ ID NO:78) which encodes the following amino acid sequence:
MetAlaAsnCysSerIleMetIleAspGluIleIleHisHisLeuLysArg-
ProProAlaProLeuLeuAspProAsnAsnLeuAsnAspGluAsp-
ValSerIleLeuMetAspArgAsnLeuArgLeuProAsnLeuGluSer-
PheValArgAlaValLysAsnLeuGluAsnAlaSerGlyIleGluAla-
IleLeuArgAsnLeuGlnProCysLeuProSerAlaThrAlaAlaPro-
SerArgHisProIleIleIleLysAlaGlyAspTrpGlnGluPheArg-
GluLysLeuThrPheTyrLeuValThrLeuGluGlnAlaGlnGlu-
GlnGlnTyrValGluGlyGlyGlyGlySerProGlyGluProSerGly-
ProIleSerThrIleAsnProSerProProSerLysGluSerHisLysSer-
ProAsnMetAlaTyrLysLeuCysHisProGluGluLeuValLeu-
LeuGlyHisSerLeuGlyIleProTrpAlaProLeuSerSerCysPro-
SerGlnAlaLeuGlnLeuAlaGlyCysLeuSerGlnLeuHisSer-
GlyLeuPheLeuTyrGlnGlyLeuLeuGlnAlaLeuGluGlyIle-
SerProGluLeuGlyProThrLeuAspThrLeuGlnLeuAspVal-
AlaAspPheAlaThrThrIleTrpGlnGlnMetGluGluLeuGly-
MetAlaProAlaLeuGlnProThrGlnGlyAlaMetProAlaPhe-
AlaSerAlaPheGlnArgArgAlaGlyGlyValLeuValAlaSerHis-
LeuGlnSerPheLeuGluValSerTyrArgValLeuArgHisLeuAla-
GlnProGlyGlyGlySerAspMetAlaThrProLeuGlyProAla-
SerSerLeuProGlnSerPheLeuLeuLysSerLeuGluGlnValArg-
LysIleGlnGlyAspGlyAlaAlaLeuGlnGluLysLeuCysAla-
Thr (SEQ ID NO:500)

EXAMPLE 47
Construction of pMON15982

Construction of pMON15982, a plasmid containing DNA sequences encoding a multi-functional hematopoietic receptor agonist. Plasmid, pMON15960, DNA was digested with restriction enzyme SmaI and used as template in a PCR reaction using synthetic DNA oligonucleotides 96 stop (SEQ ID NO:371) and 97 start (SEQ ID NO:370) as primers, resulting in the amplification of a DNA fragment of 576 base pairs. The amplified fragment was digested with restriction enzymes HindIII and NcoI, resulting in a HindIII, NcoI fragment of 558 base pairs. Plasmid, pMON13181, DNA was digested with HindIII and AflIII, resulting in a HindIII, AflIII fragment of 4068 base pairs. The restriction fragments were ligated, and the ligation reaction mixture was used to transform E. coli K-12 strain JM101. Transformant bacteria were selected on ampicillin-containing plates. Plasmid DNA was isolated, analyzed by restriction analysis, and sequenced to confirm the correct insert. The plasmid, pMON15982, contains the DNA sequence of (SEQ ID NO:79) which encodes the following amino acid sequence:
MetAlaAsnCysSerIleMetIleAspGluIleIleHisHisLeuLysArg-ProProAlaProLeuLeuAspProAsnAsnLeuAsnAspGluAsp-ValSerIleLeuMetAspArgAsnLeuArgLeuProAsnLeuGluSer-PheValArgAlaValLysAsnLeuGluAsnAlaSerGlyIleGluAla-IleLeuArgAsnLeuGlnProCysLeuProSerAlaThrAlaAlaPro-SerArgHisProIleIleIleLysAlaGlyAspTrpGlnGluPheArgGlu-LysLeuThrPheTyrLeuValThrLeuGluGlnAlaGlnGluGlnGln-TyrValGluGlyGlyGlyGlySerProGlyGluProSerGlyProIle-SerThrIleAsnProSerProProSerLysGluSerHisLysSerProAsn-MetAlaProGluLeuGlyProThrLeuAspThrLeuGlnLeuAsp-ValAlaAspPheAlaThrThrIleTrpGlnGlnMetGluGluLeuGly-MetAlaProAlaLeuGlnProThrGlnGlyAlaMetProAlaPheAla-SerAlaPheGlnArgArgAlaGlyGlyValLeuValAlaSerHisLeu-GlnSerPheLeuGluValSerTyrArgValLeuArgHisLeuAlaGln-ProGlyGlyGlySerAspMetAlaThrProLeuGlyProAlaSerSer-LeuProGlnSerPheLeuLeuLysSerLeuGluGlnValArgLysIle-GlnGlyAspGlyAlaAlaLeuGlnGluLysLeuCysAlaThrTyr-LysLeuCysHisProGluGluLeuValLeuLeuGlyHisSerLeuGly-IleProTrpAlaProLeuSerSerCysProSerGlnAlaLeuGlnLeu-AlaGlyCysLeuSerGlnLeuHisSerGlyLeuPheLeuTyrGlnGly-LeuLeuGlnAlaLeuGluGlyIleSer (SEQ ID NO:501)

EXAMPLE 48
Construction of pMON15965
Construction of pMON15965, a plasmid containing DNA sequences encoding a multi-functional hematopoietic receptor agonist. Plasmid, pMON15960, DNA was digested with restriction enzyme SmaI and used as template in a PCR reaction using synthetic DNA oligonucleotides 142 stop (SEQ ID NO:377) and 141 start (SEQ ID NO:376) as primers, resulting in the amplification of a DNA fragment of 576 base pairs. The amplified fragment was digested with restriction enzymes HindIII and NcoI, resulting in a HindIII, NcoI fragment of 558 base pairs. Plasmid, pMON13181, DNA was digested with HindIII and AflIII, resulting in a HindIII, AflIII fragment of 4068 base pairs. The restriction fragments were ligated, and the ligation reaction mixture was used to transform E. coli K-12 strain JM101. Transformant bacteria were selected on ampicillin-containing plates. Plasmid DNA was isolated, analyzed by restriction analysis, and sequenced to confirm the correct insert. The plasmid, pMON15965, contains the DNA sequence of (SEQ ID NO:80) which encodes the following amino acid sequence:
MetAlaAsnCysSerIleMetIleAspGluIleIleHisHisLeuLysArg-ProProAlaProLeuLeuAspProAsnAsnLeuAsnAspGluAsp-ValSerIleLeuMetAspArgAsnLeuArgLeuProAsnLeuGluSer-PheValArgAlaValLysAsnLeuGluAsnAlaSerGlyIleGluAla-IleLeuArgAsnLeuGlnProCysLeuProSerAlaThrAlaAlaPro-SerArgHisProIleIleIleLysAlaGlyAspTrpGlnGluPheArgGlu-LysLeuThrPheTyrLeuValThrLeuGluGlnAiaGlnGluGlnGln-TyrValGluGlyGlyGlyGlySerProGlyGluProSerGlyProIle-SerThrIleAsnProSerProProSerLysGluSerHisLysSerProAsn-MetAlaSerAlaPheGlnArgArgAlaGlyGlyValLeuValAlaSer-HisLeuGlnSerPheLeuGluValSerTyrArgValLeuArgHisLeu-AlaGlnProGlyGlyGlySerAspMetAlaThrProLeuGlyProAla-SerSerLeuProGlnSerPheLeuLeuLysSerLeuGluGlnValArg-LysIleGlnGlyAspGlyAlaAlaLeuGlnGluLysLeuCysAlaThr-TyrLysLeuCysHisProGluGluLeuValLeuLeuGlyHisSerLeu-GlyIleProTrpAlaProLeuSerSerCysProSerGlnAlaLeuGlnLeu-AlaGlyCysLeuSerGlnLeuHisSerGlyLeuPheLeuTyrGlnGly-LeuLeuGlnAlaLeuGluGlyIleSerProGluLeuGlyProThrLeuAspThrLeuGlnLeuAspValAlaAspPheAlaThrThrIleTrp-GlnGlnMetGluGluLeuGlyMetAlaProAlaLeuGlnProThr-GlnGlyAlaMetProAlaPheAla (SEQ ID NO:502)

EXAMPLE 49
Construction of pMON15966
Construction of pMON15966, a plasmid containing DNA sequences encoding a multi-functional hematopoietic receptor agonist. Plasmid, pMON15960, DNA was digested with restriction enzyme SmaI and used as template in a PCR reaction using synthetic DNA oligonucleotides 126 stop (SEQ ID NO:372) and 125 start (SEQ ID NO:373) as primers, resulting in the amplification of a DNA fragment of 576 base pairs. The amplified fragment was digested with restriction enzymes HindIII and NcoI, resulting in a HindIII, NcoI fragment of 558 base pairs. Plasmid, pMON13181, DNA was digested with HindIII and AflIII, resulting in a HindIII, AflIII fragment of 4068 base pairs. The restriction fragments were ligated, and the ligation reaction mixture was used to transform E. coli K-12 strain JM101. Transformant bacteria were selected on ampicillin-containing plates. Plasmid DNA was isolated, analyzed by restriction analysis, and sequenced to confirm the correct insert. The plasmid, pMON15966, contains the DNA sequence of (SEQ ID NO:81) which encodes the following amino acid sequence:
MetAlaAsnCysSerIleMetIleAspGluIleIleHisHisLeuLysArg-ProProAlaProLeuLeuAspProAsnAsnLeuAsnAspGluAsp-ValSerIleLeuMetAspArgAsnLeuArgLeuProAsnLeuGluSer-PheValArgAlaValLysAsnLeuGluAsnAlaSerGlyIleGluAla-IleLeuArgAsnLeuGlnProCysLeuProSerAlaThrAlaAlaPro-SerArgHisProIleIleIleLysAlaGlyAspTrpGlnGluPheArg-GluLysLeuThrPheTyrLeuValThrLeuGluGlnAlaGlnGlu-GlnGlnTyrValGluGlyGlyGlyGlySerProGlyGluProSerGly-ProIleSerThrIleAsnProSerProProSerLysGluSerHisLysSer-ProAsnMetAlaMetAlaProAlaLeuGlnProThrGlnGlyAla-MetProAlaPheAlaSerAlaPheGlnArgArgAlaGlyGlyValLeu-ValAlaSerHisLeuGlnSerPheLeuGluValSerTyrArgValLeu-ArgHisLeuAlaGlnProGlyGlyGlySerAspMetAlaThrProLeu-GlyProAlaSerSerLeuProGlnSerPheLeuLeuLysSerLeuGlu-GlnValArgLysIleGlnGlyAspGlyAlaAlaLeuGlnGluLysLeu-CysAlaThrTyrLysLeuCysHisProGluGluLeuValLeuLeuGly-HisSerLeuGlyIleProTrpAlaProLeuSerSerCysProSerGln-AlaLeuGlnLeuAlaGlyCysLeuSerGlnLeuHisSerGlyLeu-PheLeuTyrGlnGlyLeuLeuGlnAlaLeuGluGlyIleSerProGlu-LeuGlyProThrLeuAspThrLeuGlnLeuAspValAlaAspPhe-AlaThrThrIleTrpGlnGlnMetGluGluLeuGly (SEQ ID NO:503)

EXAMPLE 50
Construction of pMON15967
Construction of pMON15967, a plasmid containing DNA sequences encoding a multi-functional hematopoietic receptor agonist. Plasmid, pMON15960, DNA was digested with restriction enzyme SmaI and used as template in a PCR reaction using synthetic DNA oligonucleotides 132 stop (SEQ ID NO:375) and 133 start (SEQ ID NO:374) as primers, resulting in the amplification of a DNA fragment of 576 base pairs. The amplified fragment was digested with restriction enzymes HindIII and NcoI, resulting in a HindIII, NcoI fragment of 558 base pairs. Plasmid, pMON13181, DNA was digested with HindIII and AflIII, resulting in a HindIII, AflIII fragment of 4068 base pairs. The restriction fragments were ligated, and the ligation reaction mixture was used to transform *E. coli* K-12 strain JM101. Transformant bacteria were selected on ampicillin-containing plates. Plasmid DNA was isolated, analyzed by restriction analysis, and sequenced to confirm the correct insert. The plasmid, pMON15967, contains the DNA sequence of (SEQ ID NO: 82) which encodes the following amino acid sequence:
MetAlaAsnCysSerIleMetIleAspGluIleIleHisHisLeuLysArg-
ProProAlaProLeuLeuAspProAsnAsnLeuAsnAspGluAsp-
ValSerIleLeuMetAspArgAsnLeuArgLeuProAsnLeuGluSer-
PheValArgAlaValLysAsnLeuGluAsnAlaSerGlyIleGluAla-
IleLeuArgAsnLeuGlnProCysLeuProSerAlaThrAlaAlaPro-
SerArgHisProIleIleIleLysAlaGlyAspTrpGlnGluPheArgGlu-
LysLeuThrPheTyrLeuValThrLeuGluGlnAlaGlnGluGlnGln-
TyrValGluGlyGlyGlyGlySerProGlyGluProSerGlyProIle-
SerThrIleAsnProSerProProSerLysGluSerHisLysSerPro-
AsnMetAlaThrGlnGlyAlaMetProAlaPheAlaSerAlaPhe-
GlnArgArgAlaGlyGlyValLeuValAlaSerHisLeuGlnSerPhe-
LeuGluValSerTyrArgvalLeuArgHisLeuAlaGlnProGlyGly-
GlySerAspMetAlaThrProLeuGlyProAlaSerSerLeuProGln-
SerPheLeuLeuLysSerLeuGluGlnValArgLysIleGlnGlyAsp-
GlyAlaAlaLeuGlnGluLysLeuCysAlaThrTyrLysLeuCys-
HisProGluGluLeuValLeuLeuGlyHisSerLeuGlyIleProTrp-
AlaProLeuSerSerCysProSerGlnAlaLeuGlnLeuAlaGlyCys-
LeuSerGlnLeuHisSerGlyLeuPheLeuTyrGlnGlyLeuLeu-
GlnAlaLeuGluGlyIleSerProGluLeuGlyProThrLeuAspThr-
LeuGlnLeuAspValAlaAspPheAlaThrThrIleTrpGlnGlnMet-
GluGluLeuGlyMetAlaProAlaLeuGlnPro SEQ ID NO:504

EXAMPLE 51

Construction of pMON13180, an Intermediate Plasmid Used for Constructing Plasmids that Contain DNA Sequence Encoding Multi-Functional Hematopoietic Receptor Agonists.

Plasmid, pMON13046 (WO 95/21254), DNA was digested with restriction endonucleases XmaI and SnaBI, resulting in a 4018 base pair vector fragment. The 4018 base pair XmaI-SnaBI fragment was purified using a Magic DNA Clean-up System kit (Promega, Madison, Wis.) in which the 25 base pair XmaI-SnaBI insert fragment is not retained. The complimentary pair of synthetic oligonucleotides, glyxa1 (SEQ ID NO:378) and glyxa12 (SEQ ID NO:379), were designed to remove sequence encoding a factor Xa cleavage site. When properly assembled these oligonucleotides also result in XmaI and SnaBI ends. The primers, Glyxa1 and glyxa12, were annealed in annealing buffer (20 mM Tris-HCl pH7.5, 10 mM MgCl$_2$, 50 mM NaCl) by heating at 70° C. for ten minutes and allowed to slow cool. The 4018 base pair XmaI-SnaBI fragment from pMON13046 was ligated with the assembled oligonucleotides using T4 DNA-ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated from the transformants and analyzed using a PCR based assay. Plasmid DNA from selected transformants was sequenced to confirm the correct insertion of the oligonucleotides. The resulting plasmid was designated pMON13180 (SEQ ID NO:88).

EXAMPLE 52

Construction of pMON13181, an Intermediate Plasmid Used for Constructing Plasmids that Contain DNA Sequences Encoding Multi-Functional Hematopoietic Receptor Agonists.

Plasmid, pMON13047 (WO 95/21254), DNA was digested with restriction endonucleases XmaI and SnaBI, resulting in a 4063 base pair vector fragment. The 4063 base pair XmaI-SnaBI fragment was purified using a Magic DNA Clean-up System kit (Promega, Madison, Wis.) in which the 25 base pair XmaI-SnaBI insert fragment is not retained. The complimentary pair of synthetic oligonucleotides, glyxa1 (SEQ ID NO:378) and glyxa2 (SEQ ID NO:379), were designed to remove sequence encoding the factor Xa cleavage site. When properly assembled these oligonucleotides also result in XmaI and SnaBI ends. Glyxa1 and glyxa2 were annealed in annealing buffer by heating at 70° C. for ten minutes and allowed to slow cool. The 4063 base pair XmaI-SnaBI fragment from pMON13047 was ligated with the assembled oligonucleotides using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated from the transformants and analyzed using a PCR based assay. Plasmid DNA from selected transformants was sequenced to confirm the correct insertion of the oligonucleotides. The resulting plasmid was designated pMON13181 (SEQ ID NO:87).

EXAMPLE 53

Construction of pMON13182

The new N-terminus/C-terminus gene in pMON13182 was created using Method I as described in Materials and Methods. Fragment Start was created and amplified from G-CSF Ser$^{17}$ sequence in pMON13037 using the primer set, 39 start (SEQ ID NO:368) and L-11 start (SEQ ID NO:364). Fragment Stop was created and amplified from G-CSF Ser$^{17}$ sequence in pMON13037 using the primer set, 38 stop (SEQ ID NO:369) and L-11 stop (SEQ ID NO:365). The full-length new N terminus/C-terminus G-CSF Ser$^{17}$ gene was created and amplified from the annealed Fragments Start and Stop using primers 39 start and 38 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13182.

*E. coli* strain JM101 was transformed with pMON13182 for protein expression and protein isolation from inclusion bodies.

The plasmid, pMON13182, contains the DNA sequence of (SEQ ID NO:17) which encodes the following amino acid sequence:

Asn Cys Ser Ile Met Ile Asp Glu Ile Ile His His Leu Lys Arg (SEQ ID NO:472)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Tyr Lys Leu Cys

His Pro Glu Glu Leu Val Leu Leu Gly His Ser Leu Gly Ile Pro

Trp Ala Pro Leu Ser Ser Cys Pro Ser Gln Ala Leu Gln Leu Ala

Gly Cys Leu Ser Gln Leu His Ser Gly Leu Phe Leu Tyr Gln Gly

Leu Leu Gln Ala Leu Glu Gly Ile Ser Pro Glu Leu Gly Pro Thr

Leu Asp Thr Leu Gln Leu Asp Val Ala Asp Phe Ala Thr Thr Ile

Trp Gln Gln Met Glu Glu Leu Gly Met Ala Pro Ala Leu Gln Pro

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr

EXAMPLE 54
Construction of pMON13183

The new N-terminus/C-terminus gene in pMON13183 was created using Method I as described in Materials and Methods. "Fragment Start" was created and amplified from G-CSF Ser$^{17}$ sequence in pMON13037 using the primer set, 39 start (SEQ ID NO:368) and L-11 start (SEQ ID NO:364). Fragment Stop was created and amplified from G-CSF Ser$^{17}$ sequence in pMON13037 using the primer set, 38 stop (SEQ ID NO:369) and L-11 stop (SEQ ID NO:365). The full-length new N terminus/C-terminus G-CSF Ser$^{17}$ gene was created and amplified from the annealed Fragments Start and Stop using 39 start and 38 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13183.

*E. coli* strain JM101 was transformed with pMON13183 for protein expression and protein isolation from inclusion bodies.

The plasmid, pMON13183, contains the DNA sequence of (SEQ ID NO:18) which encodes the following amino acid sequence:

Asn Cys Ser Ile Met Ile Asp Glu Ile Ile His His Leu Lys Arg (SEQ ID NO:473)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

-continued

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Tyr Lys Leu Cys

His Pro Glu Glu Leu Val Leu Leu Gly His Ser Leu Gly Ile Pro

Trp Ala Pro Leu Ser Ser Cys Pro Ser Gln Ala Leu Gln Leu Ala

Gly Cys Leu Ser Gln Leu His Ser Gly Leu Phe Leu Tyr Gln Gly

Leu Leu Gln Ala Leu Glu Gly Ile Ser Pro Glu Leu Gly Pro Thr

Leu Asp Thr Leu Gln Leu Asp Val Ala Asp Phe Ala Thr Thr Ile

Trp Gln Gln Met Glu Glu Leu Gly Met Ala Pro Ala Leu Gln Pro

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr

EXAMPLE 55
Construction of pMON13184

The new N-terminus/C-terminus gene in pMON13184 was created using Method I as described in Materials and Methods. Fragment Start was created and amplified from G-CSF Ser[17] sequence in pMON13037 using the primer set, 97 start (SEQ ID NO:370) and L-11 start (SEQ ID NO:364). Fragment Stop was created and amplified from G-CSF Ser[17] sequence in pMON13037 using the primer set, 96 stop (SEQ ID NO:371) and L-11 stop (SEQ ID NO:365). The full-length new N terminus/C-terminus G-CSF Ser[17] gene was created and amplified from the annealed Fragments Start and Stop using 97 start and 96 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13184.

E. coli strain JM101 was transformed with pMON13184 for protein expression and protein isolation from inclusion bodies.

The plasmid, pMON13184, contains the DNA sequence of (SEQ ID NO:19) which encodes the following amino acid sequence:

Asn Cys Ser Ile Met Ile Asp Glu Ile Ile His His Leu Lys Arg (SEQ ID NO:474)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Ser Asn Met Ala Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

-continued

```
Gln Pro Thr Gln Gly Ala Met Pro Ala Phe Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Ser

Gly Gly Ser Gly Gly Ser Gln Ser Phe Leu Leu Lys Ser Leu Glu

Gln Val Arg Lys Ile Gln Gly Asp Gly Ala Ala Leu Gln Glu Lys

Leu Cys Ala Thr Tyr Lys Leu Cys His Pro Glu Glu Leu Val Leu

Leu Gly His Ser Leu Gly Ile Pro Trp Ala Pro Leu Ser Ser Cys

Pro Ser Gln Ala Leu Gln Leu Ala Gly Cys Leu Ser Gln Leu His

Ser Gly Leu Phe Leu Tyr Gln Gly Leu Leu Gln Ala Leu Glu Gly

Ile Ser
```

EXAMPLE 56
Construction of pMON13185

The new N-terminus/C-terminus gene in pMON13185 was created using Method I as described in Materials and Methods. Fragment Start was created and amplified from G-CSF Ser$^{17}$ sequence in pMON13037 using the primer set, 97 start (SEQ ID NO:370) and L-11 start (SEQ ID NO:364). Fragment Stop was created and amplified from G-CSF Ser$^{17}$ sequence in pMON13037 using the primer set, 96 stop (SEQ ID NO:371) and L-11 stop (SEQ ID NO:365). The full-length new N terminus/C-terminus G-CSF Ser$^{17}$ gene was created and amplified from the annealed Fragments Start and Stop using 97 start and 96 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13181, was digested with restriction endonucleases HindIII and AflIII, resulting in a 4068 base pair vector fragment, and purified using a Magic DNA Clean-up System kit (Promega, Madison, Wis). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13185.

*E. coli* strain JM101 was transformed with pMON13185 for protein expression and protein isolation from inclusion bodies.

The plasmid, pMON13185, contains the DNA sequence of (SEQ ID NO:20) which encodes the following amino acid sequence:

```
Asn Cys Ser Ile Met Ile Asp Glu Ile Ile His His Leu Lys Arg    (SEQ ID NO:475)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro Thr Gln Gly Ala Met Pro Ala Phe Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Ser

Gly Gly Ser Gly Gly Ser Gln Ser Phe Leu Leu Lys Ser Leu Glu

Gln Val Arg Lys Ile Gln Gly Asp Gly Ala Ala Leu Gln Glu Lys
```

-continued

Leu Cys Ala Thr Tyr Lys Leu Cys His Pro Glu Glu Leu Val Leu

Leu Gly His Ser Leu Gly Ile Pro Trp Ala Pro Leu Ser Ser Cys

Pro Ser Gln Ala Leu Gln Leu Ala Gly Cys Leu Ser Gln Leu His

Ser Gly Leu Phe Leu Tyr Gln Gly Leu Leu Gln Ala Leu Glu Gly

Ile Ser

EXAMPLE 57
Construction of pMON13186

The new N-terminus/C-terminus gene in pMON13186 was created using Method I as described in Materials and Methods. Fragment Start was created and amplified from G-CSF Ser[17] sequence in pMON13037 using the primer set, 126 start (SEQ ID NO:372) and L-11 start (SEQ ID NO:364). Fragment Stop was created and amplified from G-CSF Ser[17] sequence in pMON13037 using the primer set, 125 stop (SEQ ID NO:373) and L-11 stop (SEQ ID NO:365). The full-length new N terminus/C-terminus G-CSF Ser[17] gene was created and amplified from the annealed Fragments Start and Stop using 126 start and 125 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13186.

*E. coli* strain JM101 was transformed with pMON13186 for protein expression and protein isolation from inclusion bodies.

The plasmid, pMON13186, contains the DNA sequence of (SEQ ID NO:21) which encodes the following amino acid sequence:

Asn Cys Ser Ile Met Ile Asp Glu Ile Ile His His Leu Lys Arg  (SEQ ID NO:476)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Gly Gly Ser Gly Gly Gly Ser Asn Met Ala Met Ala Pro Ala

Leu Gln Pro Thr Gln Gly Ala Met Pro Ala Phe Ala Ser Ala Phe

Gln Arg Arg Ala Gly Gly Val Leu Val Ala Ser His Leu Gln Ser

Phe Leu Glu Val Ser Tyr Arg Val Leu Arg His Leu Ala Gln Pro

Ser Gly Gly Ser Gly Gly Ser Gln Ser Phe Leu Leu Lys Ser Leu

Glu Gln Val Arg Lys Ile Gln Gly Asp Gly Ala Ala Leu Gln Glu

Lys Leu Cys Ala Thr Tyr Lys Leu Cys His Pro Glu Glu Leu Val

Leu Leu Gly His Ser Leu Gly Ile Pro Trp Ala Pro Leu Ser Ser

Cys Pro Ser Gln Ala Leu Gln Leu Ala Gly Cys Leu Ser Gln Leu

His Ser Gly Leu Phe Leu Tyr Gln Gly Leu Leu Gln Ala Leu Glu

Gly Ile Ser Pro Glu Leu Gly Pro Thr Leu Asp Thr Leu Gln Leu

Asp Val Ala Asp Phe Ala Thr Thr Ile Trp Gln Gln Met Glu Glu

Leu Gly

EXAMPLE 58
Construction of pMON13187

The new N-terminus/C-terminus gene in pMON13187 was created using Method I as described in Materials and Methods. Fragment Start was created and amplified from G-CSF Ser[17] sequence in pMON13037 using the primer set, 126 start (SEQ ID NO:372) and L-11 start (SEQ ID NO:364). Fragment Stop was created and amplified from G-CSF Ser[17] sequence in pMON13037 using the primer set, 125 stop (SEQ ID NO:373) and L-11 stop (SEQ ID NO:365). The full-length new N terminus/C-terminus G-CSF Ser[17] gene was created and amplified from the annealed Fragments Start and Stop using 126 start and 125 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13187.

*E. coli* strain JM101 was transformed with pMON13187 for protein expression and protein isolation from inclusion bodies.

The plasmid, pMON13187, contains the DNA sequence of (SEQ ID NO:22) which encodes the following amino acid sequence:

```
Asn Cys Ser Ile Met Ile Asp Glu Ile Ile His His Leu Lys Arg (SEQ ID NO.477)
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Ser Pro
Gly Glu Pro Ser Gly Pro Ile Ser Thr Ile Asn Pro Ser Pro Pro
Ser Lys Glu Ser His Lys Ser Pro Asn Met Ala Met Ala Pro Ala
Leu Gln Pro Thr Gln Gly Ala Met Pro Ala Phe Ala Ser Ala Phe
Gln Arg Arg Ala Gly Gly Val Leu Val Ala Ser His Leu Gln Ser
Phe Leu Glu Val Ser Tyr Arg Val Leu Arg His Leu Ala Gln Pro
Ser Gly Gly Ser Gly Gly Ser Gln Ser Phe Leu Leu Lys Ser Leu
Glu Gln Val Arg Lys Ile Gln Gly Asp Gly Ala Ala Leu Gln Glu
Lys Leu Cys Ala Thr Tyr Lys Leu Cys His Pro Glu Glu Leu Val
Leu Leu Gly His Ser Leu Gly Ile Pro Trp Ala Pro Leu Ser Ser
Cys Pro Ser Gln Ala Leu Gln Leu Ala Gly Cys Leu Ser Gln Leu
His Ser Gly Leu Phe Leu Tyr Gln Gly Leu Leu Gln Ala Leu Glu
Gly Ile Ser Pro Glu Leu Gly Pro Thr Leu Asp Thr Leu Gln Leu
Asp Val Ala Asp Phe Ala Thr Thr Ile Trp Gln Gln Met Glu Glu
Leu Gly
```

EXAMPLE 59
Construction of DMON13188

The new N-terminus/C-terminus gene in pMON13188 was created using Method I as described in Materials and Methods. Fragment Start was created and amplified from G-CSF Ser[17] sequence in pMON13037 using the primer set, 133 start (SEQ ID NO:374) and L-11 start (SEQ ID NO:364). Fragment Stop was created and amplified from G-CSF Ser[17] sequence in pMON13037 using the primer set, 132 stop (SEQ ID NO:375) and L-11 stop (SEQ ID NO:365). The full-length new N terminus/C-terminus G-CSF Ser[17] gene was created and amplified from the annealed Fragments Start and Stop using 133 start and 132 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13188.

*E. coli* strain JM101 was transformed with pMON13188 for protein expression and protein isolation from inclusion bodies.

The plasmid, pMON13188, contains the DNA sequence of (SEQ ID NO:23) which encodes the following amino acid sequence:

G-CSF Ser$^{17}$ gene was created and amplified from the annealed Fragments Start and Stop using 133 start and 132 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant

```
Asn Cys Ser Ile Met Ile Asp Glu Ile Ile His His Leu Lys Arg (SEQ ID NO:478)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Thr Gln Gly Ala

Met Pro Ala Phe Ala Ser Ala Phe Gln Arg Arg Ala Gly Gly Val

Leu Val Ala Ser His Leu Gln Ser Phe Leu Glu Val Ser Tyr Arg

Val Leu Arg His Leu Ala Gln Pro Ser Gly Gly Ser Gly Gly Ser

Gln Ser Phe Leu Leu Lys Ser Leu Glu Gln Val Arg Lys Ile Gln

Gly Asp Gly Ala Ala Leu Gln Glu Lys Leu Cys Ala Thr Tyr Lys

Leu Cys His Pro Glu Glu Leu Val Leu Leu Gly His Ser Leu Gly

Ile Pro Trp Ala Pro Leu Ser Ser Cys Pro Ser Gln Ala Leu Gln

Leu Ala Gly Cys Leu Ser Gln Leu His Ser Gly Leu Phe Leu Tyr

Gln Gly Leu Leu Gln Ala Leu Glu Gly Ile Ser Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro
```

EXAMPLE 60

Construction of pMON13189

The new N-terminus/C-terminus gene in pMON13189 was created using Method I as described in Materials and Methods. Fragment Start was created and amplified from G-CSF Ser$^{17}$ sequence in pMON13037 using the primer set, 133 start (SEQ ID NO:374) and L-11 start (SEQ ID NO:364). Fragment Stop was created and amplified from G-CSF Ser$^{17}$ sequence in pMON13037 using the primer set, 132 stop (SEQ ID NO:375) and L-11 stop (SEQ ID NO:365). The full-length new N terminus/C-terminus bacteria were selected on ampicillin-containing plates. Plasmid DNA was isolated and sequenced to confirm the correct insert. The resulting plasmid was designated pMON13189.

*E. coli* strain JM101 was transformed with pMON13189 for protein expression and protein isolation from inclusion bodies.

The plasmid, pMON13189, contains the DNA sequence of (SEQ ID NO:24) which encodes the following amino acid sequence:

```
Asn Cys Ser Ile Met Ile Asp Glu Ile Ile His His Leu Lys Arg  (SEQ ID NO:479)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Thr Gln Gly Ala

Met Pro Ala Phe Ala Ser Ala Phe Gln Arg Arg Ala Gly Gly Val

Leu Val Ala Ser His Leu Gln Ser Phe Leu Glu Val Ser Tyr Arg

Val Leu Arg His Leu Ala Gln Pro Ser Gly Gly Ser Gly Gly Ser

Gln Ser Phe Leu Leu Lys Ser Leu Glu Gln Val Arg Lys Ile Gln

Gly Asp Gly Ala Ala Leu Gln Glu Lys Leu Cys Ala Thr Tyr Lys

Leu Cys His Pro Glu Glu Leu Val Leu Leu Gly His Ser Leu Gly

Ile Pro Trp Ala Pro Leu Ser Ser Cys Pro Ser Gln Ala Leu Gln

Leu Ala Gly Cys Leu Ser Gln Leu His Ser Gly Leu Phe Leu Tyr

Gln Gly Leu Leu Gln Ala Leu Glu Gly Ile Ser Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro
```

EXAMPLE 61
Construction of pMON13190

The new N-terminus/C-terminus gene in pMON13190 was created using Method I as described in Materials and Methods. Fragment Start was created and amplified from G-CSF Ser[17] sequence in pMON13037 using the primer set, 142 start (SEQ ID NO:376) and L-11 start (SEQ ID NO:364). Fragment Stop was created and amplified from G-CSF Ser[17] sequence in pMON13037 using the primer set, 141 stop (SEQ ID NO:377) and L-11 stop (SEQ ID NO:365). The full-length new N terminus/C-terminus G-CSF Ser[17] gene was created and amplified from the annealed Fragments Start and Stop using 142 start and 141 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13190.

*E. coli* strain JM101 was transformed with pMON13190 for protein expression and protein isolation from inclusion bodies.

The plasmid, pMON13190, contains the DNA sequence of (SEQ ID NO:25) which encodes the following amino acid sequence:

```
Asn Cys Ser Ile Met Ile Asp Glu Ile Ile His His Leu Lys Arg  (SEQ ID NO:480)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr
```

-continued

```
Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Gly Gly Ser Gly Gly Gly Ser Asn Met Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Ser

Gly Gly Ser Gly Gly Ser Gln Ser Phe Leu Leu Lys Ser Leu Glu

Gln Val Arg Lys Ile Gln Gly Asp Gly Ala Ala Leu Gln Glu Lys

Leu Cys Ala Thr Tyr Lys Leu Cys His Pro Glu Glu Leu Val Leu

Leu Gly His Ser Leu Gly Ile Pro Trp Ala Pro Leu Ser Ser Cys

Pro Ser Gln Ala Leu Gln Leu Ala Gly Cys Leu Ser Gln Leu His

Ser Gly Leu Phe Leu Tyr Gln Gly Leu Leu Gln Ala Leu Glu Gly

Ile Ser Pro Glu Leu Gly Pro Thr Leu Asp Thr Leu Gln Leu Asp

Val Ala Asp Phe Ala Thr Thr Ile Trp Gln Gln Met Glu Glu Leu

Gly Met Ala Pro Ala Leu Gln Pro Thr Gln Gly Ala Met Pro Ala

Phe Ala
```

EXAMPLE 62
Construction of pMON13191

The new N-terminus/C-terminus gene in pMON13191 was created using Method I as described in Materials and Methods. Fragment Start was created and amplified from G-CSF Ser[17] sequence in pMON13037 using the primer set, 142 start (SEQ ID NO:376) and L-11 start (SEQ ID NO:364). Fragment Stop was created and amplified from G-CSF Ser[17] sequence in pMON13037 using the primer set, 141 stop (SEQ ID NO:377) and L-11 stop (SEQ ID NO:365). The full-length new N terminus/C-terminus G-CSF Ser[17] gene was created and amplified from the annealed Fragments Start and Stop using 142 start and 141 stop.

The resulting DNA fragment which contains the new gene was digested with restriction endonucleases NcoI and HindIII and purified using a Magic DNA Clean-up System kit (Promega, Madison, Wis.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON13191.

*E. coli* strain JM101 was transformed with pMON13191 for protein expression and protein isolation from inclusion bodies.

The plasmid, pMON13191, contains the DNA sequence of (SEQ ID NO:26) which encodes the following amino acid sequence:

```
Asn Cys Ser Ile Met Ile Asp Glu Ile Ile His His Leu Lys Arg (SEQ ID NO:481)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Ser Ala Phe Gln

Arg Arg Ala Gly Gly Val Leu Val Ala Ser His Leu Gln Ser Phe
```

-continued

Leu Glu Val Ser Tyr Arg Val Leu Arg His Leu Ala Gln Pro Ser

Gly Gly Ser Gly Gly Ser Gln Ser Phe Leu Leu Lys Ser Leu Glu

Gln Val Arg Lys Ile Gln Gly Asp Gly Ala Ala Leu Gln Glu Lys

Leu Cys Ala Thr Tyr Lys Leu Cys His Pro Glu Glu Leu Val Leu

Leu Gly His Ser Leu Gly Ile Pro Trp Ala Pro Leu Ser Ser Cys

Pro Ser Gln Ala Leu Gln Leu Ala Gly Cys Leu Ser Gln Leu His

Ser Gly Leu Phe Leu Tyr Gln Gly Leu Leu Gln Ala Leu Glu Gly

Ile Ser Pro Glu Leu Gly Pro Thr Leu Asp Thr Leu Gln Leu Asp

Val Ala Asp Phe Ala Thr Thr Ile Trp Gln Gln Met Glu Glu Leu

Gly Met Ala Pro Ala Leu Gln Pro Thr Gln Gly Ala Met Pro Ala

Phe Ala

EXAMPLE 63
Construction of pMON13192

The new N-terminus/C-terminus gene in pMON13192 was created using Method II as described in Materials and Methods. Fragment Start was created and amplified from G-CSF sequence in pMON13037 using the primer set, 39 start (SEQ ID NO:368) and P-bl start (SEQ ID NO:366). Fragment Stop was created and amplified from G-CSF Ser[17] sequence in pMON13037 using the primer set, 38 stop (SEQ ID NO:369) and P-bl stop (SEQ ID NO:367). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser[17] gene was isolated using Geneclean (Bio101, Vista, Calif.). The intermediate plasmid, pMON13180, was digested with restriction endonucleases HindIII and AflIII, resulting in a 4023. base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13192.

*E. coli* strain JM101 was transformed with pMON13192 for protein expression and protein isolation from inclusion bodies.

The plasmid, pMON13192, contains the DNA sequence of (SEQ ID NO:27) which encodes the following amino acid sequence:

13192.Pept

Asn Cys Ser Ile Met Ile Asp Glu Ile Ile His His Leu Lys Arg (SEQ ID NO:482)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Gly Gly Ser Gly Gly Gly Ser Asn Met Ala Tyr Lys Leu Cys

His Pro Glu Glu Leu Val Leu Leu Gly His Ser Leu Gly Ile Pro

Trp Ala Pro Leu Ser Ser Cys Pro Ser Gln Ala Leu Gln Leu Ala

Gly Cys Leu Ser Gln Leu His Ser Gly Leu Phe Leu Tyr Gln Gly

Leu Leu Gln Ala Leu Glu Gly Ile Ser Pro Glu Leu Gly Pro Thr

-continued

```
Leu Asp Thr Leu Gln Leu Asp Val Ala Asp Phe Ala Thr Thr Ile

Trp Gln Gln Met Glu Glu Leu Gly Met Ala Pro Ala Leu Gln Pro

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Thr Pro Leu

Gly Pro Ala Ser Ser Leu Pro Gln Ser Phe Leu Leu Lys Ser Leu

Glu Gln Val Arg Lys Ile Gln Gly Asp Gly Ala Ala Leu Gln Glu

Lys Leu Cys Ala Thr
```

EXAMPLE 64
Construction of pMON13193

The new N-terminus/C-terminus gene in pMON13193 was created using Method II as described in Materials and Methods. Fragment Start was created and amplified from G-CSF Ser[17] sequence in pMON13037 using the primer set, 39 start (SEQ ID NO:368) and P-bl start (SEQ ID NO:366). Fragment Stop was created and amplified from G-CSF Ser[17] sequence in pMON13037 using the primer set, 38 stop (SEQ ID NO:369) and P-bl stop (SEQ ID NO:367). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser[17] gene was isolated using Geneclean (Bio101, Vista, Calif.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13193.

*E. coli* strain JM101 was transformed with pMON13193 for protein expression and protein isolation from inclusion bodies.

The plasmid, pMON13193, contains the DNA sequence of (SEQ ID NO:28) encodes the following amino acid sequence:

```
Asn Cys Ser Ile Met Ile Asp Glu Ile Ile His His Leu Lys Arg   (SEQ ID NO:483)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Tyr Lys Leu Cys

His Pro Glu Glu Leu Val Leu Leu Gly His Ser Leu Gly Ile Pro

Trp Ala Pro Leu Ser Ser Cys Pro Ser Gln Ala Leu Gln Leu Ala

Gly Cys Leu Ser Gln Leu His Ser Gly Leu Phe Leu Tyr Gln Gly

Leu Leu Gln Ala Leu Glu Gly Ile Ser Pro Glu Leu Gly Pro Thr

Leu Asp Thr Leu Gln Leu Asp Val Ala Asp Phe Ala Thr Thr Ile

Trp Gln Gln Met Glu Glu Leu Gly Met Ala Pro Ala Leu Gln Pro
```

-continued

```
Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Thr Pro Leu

Gly Pro Ala Ser Ser Leu Pro Gln Ser Phe Leu Leu Lys Ser Leu

Glu Gln Val Arg Lys Ile Gln Gly Asp Gly Ala Ala Leu Gln Glu

Lys Leu Cys Ala Thr
```

EXAMPLE 65
Construction of pMON25190

The new N-terminus/C-terminus gene in pMON25190 was created using Method II as described in Materials and Methods. Fragment Start was created and amplified from G-CSF sequence in pMON13037 using the primer set, 97 start (SEQ ID NO:370) and P-bl start (SEQ ID NO:366). Fragment Stop was created and amplified from G-CSF Ser$^{17}$ sequence in pMON13037 using the primer set, 96 stop (SEQ ID NO:371) and P-bl stop (SEQ ID NO:367). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser$^{17}$ gene and was digested with restriction endonucleases NcoI and HindIII. The digested DNA was resolved on a 1% TAE gel, stained with ethidium bromide and the full-length new N-terminus/C-terminus G-CSF Ser$^{17}$ gene was isolated using Geneclean (Bio101, Vista, Calif.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON25190.

*E. coli* strain JM101 was transformed with pMON25190 for protein expression and protein isolation from inclusion bodies.

The plasmid, pMON25190, contains the DNA sequence of (SEQ ID NO:29) which encodes the following amino acid sequence:

```
Asn Cys Ser Ile Met Ile Asp Glu Ile Ile His His Leu Lys Arg  (SEQ ID NO:484)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro Thr Gln Gly Ala Met Pro Ala Phe Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Thr

Pro Leu Gly Pro Ala Ser Ser Leu Pro Gln Ser Phe Leu Leu Lys

Ser Leu Glu Gln Val Arg Lys Ile Gln Gly Asp Gly Ala Ala Leu

Gln Glu Lys Leu Cys Ala Thr Tyr Lys Leu Cys His Pro Glu Glu

Leu Val Leu Leu Gly His Ser Leu Gly Ile Pro Trp Ala Pro Leu

Ser Ser Cys Pro Ser Gln Ala Leu Gln Leu Ala Gly Cys Leu Ser
```

-continued

Gln Leu His Ser Gly Leu Phe Leu Tyr Gln Gly Leu Leu Gln Ala

Leu Glu Gly Ile Ser

EXAMPLE 66
Construction of pMON25191

The new N-terminus/C-terminus gene in pMON25191 was created using Method II as described in Materials and Methods. Fragment Start was created and amplified from G-CSF Ser$^{17}$ sequence in pMON13037 using the primer set, 97 start (SEQ ID NO:370) and P-bl start (SEQ ID NO:366). Fragment Stop was created and amplified from G-CSF Ser$^{17}$ sequence in pMON13037 using the primer set, 96 stop (SEQ ID NO:371) and P-bl stop (SEQ ID NO:367). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser$^{17}$ gene and was digested with restriction endonucleases NcoI and HindIII. The digested DNA was resolved on a 1% TAE gel, stained with ethidium bromide and the full-length new N-terminus/C-terminus G-CSF Ser$^{17}$ gene was isolated using Geneclean (Bio101, Vista, Calif.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON25191.

*E. coli* strain JM101 was transformed with pMON25191 for protein expression and protein isolation from inclusion bodies.

The plasmid, pMON25191, contains the DNA sequence of (SEQ ID NO:30) which encodes the following amino acid sequence:

```
Asn Cys Ser Ile Met Ile Asp Glu Ile Ile His His Leu Lys Arg     (SEQ ID NO: 485)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Pro Glu Leu Gly

Pro Thr Leu Asp Thr Leu Gln Leu Asp Val Ala Asp Phe Ala Thr

Thr Ile Trp Gln Gln Met Glu Glu Leu Gly Met Ala Pro Ala Leu

Gln Pro Thr Gln Gly Ala Met Pro Ala Phe Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Thr

Pro Leu Gly Pro Ala Ser Ser Leu Pro Gln Ser Phe Leu Leu Lys

Ser Leu Glu Gln Val Arg Lys Ile Gln Gly Asp Gly Ala Ala Leu

Gln Glu Lys Leu Cys Ala Thr Tyr Lys Leu Cys His Pro Glu Glu

Leu Val Leu Leu Gly His Ser Leu Gly Ile Pro Trp Ala Pro Leu

Ser Ser Cys Pro Ser Gln Ala Leu Gln Leu Ala Gly Cys Leu Ser

Gln Leu His Ser Gly Leu Phe Leu Tyr Gln Gly Leu Leu Gln Ala

Leu Glu Gly Ile Ser
```

EXAMPLE 67
Construction of DMON13194

The new N-terminus/C-terminus gene in pMON13194 was created using Method II as described in Materials and Methods. Fragment Start was created and amplified from G-CSF Ser[17] sequence in pMON13037 using the primer set, 126 start (SEQ ID NO:372) and P-bl start (SEQ ID NO:366). Fragment Stop was created and amplified from G-CSF Ser[17] sequence in pMON13037 using the primer set, 125 stop (SEQ ID NO:371) and P-bl stop (SEQ ID NO:367). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser[17] gene was isolated using Geneclean (Bio101, Vista, Calif.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13194.

*E. coli* strain JM101 was transformed with pMON13194 for protein expression and protein isolation from inclusion bodies.

The plasmid, pMON13194, contains the DNA sequence of (SEQ ID NO:31) which encodes the following amino acid sequence:

```
Asn Cys Ser Ile Met Ile Asp Glu Ile Ile His His Leu Lys Arg  (SEQ ID NO: 486)
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Ser Pro
Gly Gly Gly Ser Gly Gly Ser Asn Met Ala Met Ala Pro Ala
Leu Gln Pro Thr Gln Gly Ala Met Pro Ala Phe Ala Ser Ala Phe
Gln Arg Arg Ala Gly Gly Val Leu Val Ala Ser His Leu Gln Ser
Phe Leu Glu Val Ser Tyr Arg Val Leu Arg His Leu Ala Gln Pro
Thr Pro Leu Gly Pro Ala Ser Ser Leu Pro Gln Ser Phe Leu Leu
Lys Ser Leu Glu Gln Val Arg Lys Ile Gln Gly Asp Gly Ala Ala
Leu Gln Glu Lys Leu Cys Ala Thr Tyr Lys Leu Cys His Pro Glu
Glu Leu Val Leu Leu Gly His Ser Leu Gly Ile Pro Trp Ala Pro
Leu Ser Ser Cys Pro Ser Gln Ala Leu Gln Leu Ala Gly Cys Leu
Ser Gln Leu His Ser Gly Leu Phe Leu Tyr Gln Gly Leu Leu Gln
Ala Leu Glu Gly Ile Ser Pro Glu Leu Gly Pro Thr Leu Asp Thr
Leu Gln Leu Asp Val Ala Asp Phe Ala Thr Thr Ile Trp Gln Gln
Met Glu Glu Leu Gly
```

EXAMPLE 68
Construction of pMON13195

The new N-terminus/C-terminus gene in pMON13195 was created using Method II as described in Materials and Methods. Fragment Start was created and amplified from G-CSF Ser[17] sequence in pMON13037 using the primer set, 126 start (SEQ ID NO:372 and P-bl start (SEQ ID NO:366). Fragment Stop was created and amplified from G-CSF Ser[17] sequence in pMON13037 using the primer set, 125 stop (SEQ ID NO:373) and P-bl stop (SEQ ID NO:367). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser[17] gene was isolated using Geneclean (Bio101, Vista, Calif.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13195.

*E. coli* strain JM101 was transformed with pMON13195 for protein expression and protein isolation from inclusion bodies.

The plasmid, pMON13195, contains the DNA sequence of (SEQ ID NO:32) which encodes the following amino acid sequence:

EXAMPLE 69
Construction of pMON13196

The new N-terminus/C-terminus gene in pMON13196 was created using Method II as described in Materials and Methods. Fragment Start was created and amplified from G-CSF sequence in pMON13037 using the primer set, 133 start (SEQ ID NO:374) and P-bl start (SEQ ID NO:366). Fragment Stop was created and amplified from G-CSF Ser[17] sequence in pMON13037 using the primer set, 132 stop (SEQ ID NO:375) and P-bl stop (SEQ ID NO:367). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser[17] gene was isolated using Geneclean (Bio101, Vista, Calif.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restric-

```
Asn Cys Ser Ile Met Ile Asp Glu Ile Ile His His Leu Lys Arg (SEQ ID NO: 487)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Met Ala Pro Ala

Leu Gln Pro Thr Gln Gly Ala Met Pro Ala Phe Ala Ser Ala Phe

Gln Arg Arg Ala Gly Gly Val Leu Val Ala Ser His Leu Gln Ser

Phe Leu Glu Val Ser Tyr Arg Val Leu Arg His Leu Ala Gln Pro

Thr Pro Leu Gly Pro Ala Ser Ser Leu Pro Gln Ser Phe Leu Leu

Lys Ser Leu Glu Gln Val Arg Lys Ile Gln Gly Asp Gly Ala Ala

Leu Gln Glu Lys Leu Cys Ala Thr Tyr Lys Leu Cys His Pro Glu

Glu Leu Val Leu Leu Gly His Ser Leu Gly Ile Pro Trp Ala Pro

Leu Ser Ser Cys Pro Ser Gln Ala Leu Gln Leu Ala Gly Cys Leu

Ser Gln Leu His Ser Gly Leu Phe Leu Tyr Gln Gly Leu Leu Gln

Ala Leu Glu Gly Ile Ser Pro Glu Leu Gly Pro Thr Leu Asp Thr

Leu Gln Leu Asp Val Ala Asp Phe Ala Thr Thr Ile Trp Gln Gln

Met Glu Glu Leu Gly
``` tion fragments were combined and ligated using T4 DNA ligase (Boehringer Mannheim, Indianapolis, Ind.). A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13196.

E. coli strain JM101 was transformed with pMON13196 for protein expression and protein isolation from inclusion bodies.

The plasmid, pMON13196, contains the DNA sequence of (SEQ ID NO:33) which encodes the following amino acid sequence:

```
Asn Cys Ser Ile Met Ile Asp Glu Ile Ile His His Leu Lys Arg  (SEQ ID NO: 488)
Pro Pro Ala Pro Leu Leu Asp Pro Asn Asn Leu Asn Asp Glu Asp
Val Ser Ile Leu Met Asp Arg Asn Leu Arg Leu Pro Asn Leu Glu
Ser Phe Val Arg Ala Val Lys Asn Leu Glu Asn Ala Ser Gly Ile
Glu Ala Ile Leu Arg Asn Leu Gln Pro Cys Leu Pro Ser Ala Thr
Ala Ala Pro Ser Arg His Pro Ile Ile Ile Lys Ala Gly Asp Trp
Gln Glu Phe Arg Glu Lys Leu Thr Phe Tyr Leu Val Thr Leu Glu
Gln Ala Gln Glu Gln Gln Tyr Val Glu Gly Gly Gly Gly Ser Pro
Gly Gly Gly Ser Gly Gly Gly Ser Asn Met Ala Thr Gln Gly Ala
Met Pro Ala Phe Ala Ser Ala Phe Gln Arg Arg Ala Gly Gly Val
Leu Val Ala Ser His Leu Gln Ser Phe Leu Glu Val Ser Tyr Arg
Val Leu Arg His Leu Ala Gln Pro Thr Pro Leu Gly Pro Ala Ser
Ser Leu Pro Gln Ser Phe Leu Leu Lys Ser Leu Glu Gln Val Arg
Lys Ile Gln Gly Asp Gly Ala Ala Leu Gln Glu Lys Leu Cys Ala
Thr Tyr Lys Leu Cys His Pro Glu Glu Leu Val Leu Leu Gly His
Ser Leu Gly Ile Pro Trp Ala Pro Leu Ser Ser Cys Pro Ser Gln
Ala Leu Gln Leu Ala Gly Cys Leu Ser Gln Leu His Ser Gly Leu
Phe Leu Tyr Gln Gly Leu Leu Gln Ala Leu Glu Gly Ile Ser Pro
Glu Leu Gly Pro Thr Leu Asp Thr Leu Gln Leu Asp Val Ala Asp
Phe Ala Thr Thr Ile Trp Gln Gln Met Glu Glu Leu Gly Met Ala
Pro Ala Leu Gln Pro
```

EXAMPLE 70
Construction of pMON13197

The new N-terminus/C-terminus gene in pMON13197 was created using Method II as described in Materials and Methods. Fragment Start was created and amplified from G-CSF Ser[17] sequence in pMON13037 using the primer set, 133 start (SEQ ID NO:374) and P-bl start (SEQ ID NO:366). Fragment Stop was created and amplified from G-CSF Ser[17] sequence in pMON13037 using the primer set, 132 stop (SEQ ID NO:375) and P-bl stop (SEQ ID NO:367). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser[17] gene was isolated using Geneclean (Bio101, Vista, Calif.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13197.

E. coli strain JM101 was transformed with pMON13197 for protein expression and protein isolation from inclusion bodies.

The plasmid, pMON13197, contains the DNA sequence of (SEQ ID NO:34) which encodes the following amino acid sequence:

Asn Cys Ser Ile Met Ile Asp Glu Ile Ile His His Leu Lys Arg (SEQ ID NO: 489)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Tyr Lys Leu Cys

His Pro Glu Glu Leu Val Leu Leu Gly His Ser Leu Gly Ile Pro

Trp Ala Pro Leu Ser Ser Cys Pro Ser Gln Ala Leu Gln Leu Ala

Gly Cys Leu Ser Gln Leu His Ser Gly Leu Phe Leu Tyr Gln Gly

Leu Leu Gln Ala Leu Glu Gly Ile Ser Pro Glu Leu Gly Pro Thr

Leu Asp Thr Leu Gln Leu Asp Val Ala Asp Phe Ala Thr Thr Ile

Trp Gln Gln Met Glu Glu Leu Gly Met Ala Pro Ala Leu Gln Pro

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Thr Pro Leu

Gly Pro Ala Ser Ser Leu Pro Gln Ser Phe Leu Leu Lys Ser Leu

Glu Gln Val Arg Lys Ile Gln Gly Asp Gly Ala Ala Leu Gln Glu

Lys LeuCys Ala Thr

EXAMPLE 71
Construction of pMON13198

The new N-terminus/C-terminus gene in pMON13198 was created using Method II as described in Materials and Methods. Fragment Start was created and amplified from G-CSF sequence in pMON13037 using the primer set, 142 start (SEQ ID NO:376) and P-bl start (SEQ ID NO:366). Fragment Stop was created and amplified from G-CSF Ser$^{17}$ sequence in pMON13037 using the primer set, 141 stop (SEQ ID NO:377) and P-bl stop (SEQ ID NO:367). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser$^{17}$ gene and was digested with restriction endonucleases NcoI and HindIII. The digested DNA was resolved on a 1% TAE gel, stained with ethidium bromide and the full-length new N-terminus/C-terminus G-CSF Ser$^{17}$ gene was isolated using Geneclean (Bio101, Vista, Calif.). The intermediate plasmid, pMON13180, was digested with restriction endonucleases HindIII and AflIII, resulting in a 4023 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13198.

*E. coli* strain JM101 was transformed with pMON13198 for protein expression and protein isolation from inclusion bodies.

The plasmid, pMON13198, contains the DNA sequence of (SEQ ID NO:35) which encodes the following amino acid sequence:

Asn Cys Ser Ile Met Ile Asp Glu Ile Ile His His Leu Lys Arg (SEQ ID NO: 490)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

-continued

```
Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu

Gln Ala Gln Glu Gln Gln Tyr Val Glu Gly Gly Gly Gly Ser Pro

Gly Gly Gly Ser Gly Gly Gly Ser Asn Met Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Thr

Pro Leu Gly Pro Ala Ser Ser Leu Pro Gln Ser Phe Leu Leu Lys

Ser Leu Glu Gln Val Arg Lys Ile Gln Gly Asp Gly Ala Ala Leu

Gln Glu Lys Leu Cys Ala Thr Tyr Lys Leu Cys His Pro Glu Glu

Leu Val Leu Leu Gly His Ser Leu Gly Ile Pro Trp Ala Pro Leu

Ser Ser Cys Pro Ser Gln Ala Leu Gln Leu Ala Gly Cys Leu Ser

Gln Leu His Ser Gly Leu Phe Leu Tyr Gln Gly Leu Leu Gln Ala

Leu Glu Gly Ile Ser Pro Glu Leu Gly Pro Thr Leu Asp Thr Leu

Gln Leu Asp Val Ala Asp Phe Ala Thr Thr Ile Trp Gln Gln Met

Glu Glu Leu Gly Met Ala Pro Ala Leu Gln Pro Thr Gln Gly Ala

Met Pro Ala Phe Ala
```

EXAMPLE 72
Construction of pMON13199

The new N-terminus/C-terminus gene in pMON13199 was created using Method II as described in Materials and Methods. Fragment Start was created and amplified from G-CSF Ser[17] sequence in pMON13037 using the primer set, 142 start (SEQ ID NO:376) and P-bl start (SEQ ID NO:366). Fragment Stop was created and amplified from G-CSF Ser[17] sequence in pMON13037 using the primer set, 141 stop (SEQ ID NO:377) and P-bl stop (SEQ ID NO:367). Fragment Start was digested with restriction endonuclease NcoI, and Fragment Stop was digested with restriction endonuclease HindIII. After purification, the digested Fragments Start and Stop were combined with and ligated to the approximately 3800 base pair NcoI-HindIII vector fragment of pMON3934.

The intermediate plasmid described above contained the full length new N-terminus/C-terminus G-CSF Ser[17] gene and was digested with restriction endonucleases NcoI and HindIII. The digested DNA was resolved on a 1% TAE gel, stained with ethidium bromide and the full-length new N-terminus/C-terminus G-CSF Ser gene was isolated using Geneclean (Bio101, Vista, Calif.). The intermediate plasmid, pMON13181, was digested with restriction endonucleases HindIII and AflIII, resulting in a 4068 base pair vector fragment, and purified using a Magic DNA Clean-up System kit (Promega, Madison, Wis.). The purified restriction fragments were combined and ligated using T4 DNA ligase (Boehringer Mannheim, Indianapolis, Ind.). A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insertion of the new gene. The resulting plasmid was designated pMON13199.

E. coli strain JM101 was transformed with pMON13199 for protein expression and protein isolation from inclusion bodies.

The plasmid, pMON13199, contains the DNA sequence of (SEQ ID NO:36) which encodes the following amino acid sequence:

```
Asn Cys Ser Ile Met Ile Asp Glu Ile Ile His His Leu Lys Arg    (SEQ ID NO: 491)

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Asn Ala Ser Gly Ile

Glu Ala Ile Leu Arg Asn Leu Gln Pro Cys Leu Pro Ser Ala Thr

Ala Ala Pro Ser Arg His Pro Ile Ile Ile Lys Ala Gly Asp Trp

Gln Glu Phe Arg Glu Lys Leu Thr Phe Tyr Leu Val Thr Leu Glu
```

-continued

```
Gln Ala Gln Glu Gln Gln Tyr Val Glu Gly Gly Gly Ser Pro

Gly Glu Pro Ser Gly Pro Ile Ser Thr Ile Asn Pro Ser Pro Pro

Ser Lys Glu Ser His Lys Ser Pro Asn Met Ala Ser Ala Phe Gln

Arg Arg Ala Gly Gly Val Leu Val Ala Ser His Leu Gln Ser Phe

Leu Glu Val Ser Tyr Arg Val Leu Arg His Leu Ala Gln Pro Thr

Pro Leu Gly Pro Ala Ser Ser Leu Pro Gln Ser Phe Leu Leu Lys

Ser Leu Glu Gln Val Arg Lys Ile Gln Gly Asp Gly Ala Ala Leu

Gln Glu Lys Leu Cys Ala Thr Tyr Lys Leu Cys His Pro Glu Glu

Leu Val Leu Leu Gly His Ser Leu Gly Ile Pro Trp Ala Pro Leu

Ser Ser Cys Pro Ser Gln Ala Leu Gln Leu Ala Gly Cys Leu Ser

Gln Leu His Ser Gly Leu Phe Leu Tyr Gln Gly Leu Leu Gln Ala

Leu Glu Gly Ile Ser Pro Glu Leu Gly Pro Thr Leu Asp Thr Leu

Gln Leu Asp Val Ala Asp Phe Ala Thr Thr Ile Trp Gln Gln Met

Glu Glu Leu Gly Met Ala Pro Ala Leu Gln Pro Thr Gln Gly Ala

Met Pro Ala Phe Ala
```

EXAMPLE 73

Construction of Tandemly-Duplicated Plasmid Template, Syntan1

To create the tandemly-duplicated hIL-3 receptor agonist pMON13416 template, Syntan1, three DNAs were joined by means of ligation using T4 DNA ligase (Boehringer Mannheim). The three DNAs are: 1) pMON13046, containing hIL-3 receptor agonist pMON13416, digested with BstEII and SnaBI; 2) the annealed complimentary pair of synthetic oligonucleotides, L1syn.for (SEQ ID NO:352) and L1syn.rev (SEQ ID NO:353), which contain sequence encoding the linker that connects the C-terminal and N-terminal ends of the original protein and a small amount of surrounding pMON13416 sequence and which when properly assembled result in BstEII and ClaI ends; and 3) a portion of hIL-3 receptor agonist pMON13416 digested from pMON13046 with ClaI (DNA had been grown in the dam- cells, DM1 (Life Technologies)) and SnaBI. The digested DNAs were resolved on a 0.9% TAE gel, stained with ethidium bromide and isolated using Geneclean (Bio101).

A portion of the ligation reaction was used to transform E. coli strain DH5α cells (Life Technologies, Gaithersburg, Md.). Miniprep DNA was isolated from the transformants, and the transformants were screened using a PCR based assay. Plasmid DNA from selected transformants was sequenced to obtain the correct template. The resulting plasmid was designated syntan1 and contains the DNA sequence of (SEQ ID NO:7).

EXAMPLE 74

Construction of Tandemly-Duplicated Template, Syntan3.

To create the tandemly-duplicated hIL-3 receptor agonist pMON13416 template, syntan3, three DNAs were joined by means of ligation using T4 DNA ligase (Boehringer Mannheim). The three DNAs are: 1) pMON13046, containing hIL-3 receptor agonist pMON13416, digested with BstEII and SnaBI; 2) the annealed complimentary pair of synthetic oligonucleotides, L3syn.for (SEQ ID NO:354) and L3syn.rev (SEQ ID NO:355), which contain sequence encoding the linker that connects the C-terminal and N-terminal ends of the original protein and a small amount of surrounding pMON13416 sequence and which when properly assembled result in BstEII and SnaBI ends; and 3) a portion of hIL-3 receptor agonist pMON13416 digested from pMON13046 with ClaI (DNA had been grown in the dam- cells, DM1 (Life Technologies)) and SnaBI. The digested DNAs were resolved on a 0.9% TAE gel, stained with ethidium bromide and isolated using Geneclean (Bio101).

A portion of the ligation reaction was used to transform E. coli strain DH5α cells (Life Technologies, Gaithersburg, Md.). Miniprep DNA was isolated from the transformants, and the transformants were screened using a PCR based assay. Plasmid DNA from selected transformants was sequenced to obtain the correct template. The resulting plasmid was designated syntan3 and contains the DNA sequence of (SEQ ID NO:8).

EXAMPLE 75

Construction of pMON31104

The new N-terminus/C-terminus gene in pMON31104 was created using Method III as described in Materials and Methods. The full length new N-terminus/C-terminus gene of hIL-3 receptor agonist pMON13416 was created and amplified from the intermediate plasmid, Syntan1, using the primer set 35 start (SEQ ID NO:356) and 34 rev (SEQ ID NO:357).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector, pMON13189, using T4 DNA ligase (Boehringer Mannheim, Indianapolis, Ind.). The pMON13189 DNA had been previously digested with NcoI and SnaBI to remove the hIL3 receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31104.

E. coli strain JM101 was transformed with pMON31104 for protein expression and protein isolation from inclusion bodies.

The plasmid, pMON31104, contains the DNA sequence of (SEQ ID NO:9) which encodes the following amino acid sequence:

amplified from the intermediate plasmid, Syntan1, using the primer set 70 start (SEQ ID NO:358) and 69 rev (SEQ ID NO:359).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL3 receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform E. coli strain DH5α cells (Life Technologies, Gaithersburg, Md.). Transformant bac-

```
Leu Asp Pro Asn Asn Leu Asn Asp Glu Asp Val Ser Ile Leu Met (SEQ ID NO: 492)

Asp Arg Asn Leu Arg Leu Pro Asn Leu Glu Ser Phe Val Arg Ala

Val Lys Asn Leu Glu Asn Ala Ser Gly Ile Glu Ala Ile Leu Arg

Asn Leu Gln Pro Cys Leu Pro Ser Ala Thr Ala Ala Pro Ser Arg

His Pro Ile Ile Ile Lys Ala Gly Asp Trp Gln Glu Phe Arg Glu

Lys Leu Thr Phe Tyr Leu Val Thr Leu Glu Gln Ala Gln Glu Gln

Gln Gly Gly Gly Ser Asn Cys Ser Ile Met Ile Asp Glu Ile Ile

His His Leu Lys Arg Pro Pro Ala Pro Leu Tyr Val Glu Gly Gly

Gly Gly Ser Pro Gly Glu Pro Ser Gly Pro Ile Ser Thr Ile Asn

Pro Ser Pro Pro Ser Lys Glu Ser His Lys Ser Pro Asn Met Ala

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr Tyr Lys Leu Cys His Pro Glu Glu Leu Val Leu Leu Gly

His Ser Leu Gly Ile Pro Trp Ala Pro Leu Ser Ser Cys Pro Ser

Gln Ala Leu Gln Leu Ala Gly Cys Leu Ser Gln Leu His Ser Gly

Leu Phe Leu Tyr Gln Gly Leu Leu Gln Ala Leu Glu Gly Ile Ser

Pro Glu Leu Gly Pro Thr Leu Asp Thr Leu Gln Leu Asp Val Ala

Asp Phe Ala Thr Thr Ile Trp Gln Gln Met Glu Glu Leu Gly Met

Ala Pro Ala Leu Gln Pro
```

EXAMPLE 76

Construction of pMON31105

The new N-terminus/C-terminus gene in pMON31105 was created using Method III as described in Materials and Methods. The full length new N-terminus/C-terminus gene of hIL-3 receptor agonist pMON13416 was created and teria were selected on ampicillin-containing plates. Plasmid DNA was isolated and sequenced to confirm the correct insert. The resulting plasmid was designated pMON31105.

E. coli strain JM101 was transformed with pMON31105 for protein expression and protein isolation from inclusion bodies.

The plasmid, pMON31105, contains the DNA sequence of (SEQ ID NO:10) which encodes the protein with the following amino acid sequence:

Asn Ala Ser Gly Ile Glu Ala Ile Leu Arg Asn Leu Gln Pro Cys (SEQ ID NO: 493)

Leu Pro Ser Ala Thr Ala Ala Pro Ser Arg His Pro Ile Ile Ile

Lys Ala Gly Asp Trp Gln Glu Phe Arg Glu Lys Leu Thr Phe Tyr

Leu Val Thr Leu Glu Gln Ala Gln Glu Gln Gln Gly Gly Gly Ser

Asn Cys Ser Ile Met Ile Asp Glu Ile Ile His His Leu Lys Arg

Pro Pro Ala Pro Leu Leu Asp Pro Asn Asn Leu Asn Asp Glu Asp

Val Ser Ile Leu Met Asp Arg Asn Leu Arg Leu Pro Asn Leu Glu

Ser Phe Val Arg Ala Val Lys Asn Leu Glu Tyr Val Glu Gly Gly

Gly Gly Ser Pro Gly Glu Pro Ser Gly Pro Ile Ser Thr Ile Asn

Pro Ser Pro Pro Ser Lys Glu Ser His Lys Ser Pro Asn Met Ala

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr Tyr Lys Leu Cys His Pro Glu Glu Leu Val Leu Leu Gly

His Ser Leu Gly Ile Pro Trp Ala Pro Leu Ser Ser Cys Pro Ser

Gln Ala Leu Gln Leu Ala Gly Cys Leu Ser Gln Leu His Ser Gly

Leu Phe Leu Tyr Gln Gly Leu Leu Gln Ala Leu Glu Gly Ile Ser

Pro Glu Leu Gly Pro Thr Leu Asp Thr Leu Gln Leu Asp Val Ala

Asp Phe Ala Thr Thr Ile Trp Gln Gln Met Glu Glu Leu Gly Met

Ala Pro Ala Leu Gln Pro

EXAMPLE 77
Construction of pMON31106

The new N-terminus/C-terminus gene in pMON31106 was created using Method III as described in Materials and Methods. The full length new N-terminus/C-terminus gene of hIL-3 receptor agonist pMON13416 was created and amplified from the intermediate plasmid, Syntan1, using the primer set 91 start (SEQ ID NO:360) and 90 rev (SEQ ID NO:361).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL3 receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31106.

E. coli strain JM101 was transformed with pMON31106 for protein expression and protein isolation from inclusion bodies.

The plasmid, pMON31106, contains the DNA sequence of (SEQ ID NO:11) which encodes the protein with the following amino acid sequence:

Ala Pro Ser Arg His Pro Ile Ile Ile Lys Ala Gly Asp Trp Gln (SEQ ID NO: 494)

Glu Phe Arg Glu Lys Leu Thr Phe Tyr Leu Val Thr Leu Glu Gln

Ala Gln Glu Gln Gln Gly Gly Gly Ser Asn Cys Ser Ile Met Ile

Asp Glu Ile Ile His His Leu Lys Arg Pro Pro Ala Pro Leu Leu

Asp Pro Asn Asn Leu Asn Asp Glu Asp Val Ser Ile Leu Met Asp

-continued

Arg Asn Leu Arg Leu Pro Asn Leu Glu Ser Phe Val Arg Ala Val

Lys Asn Leu Glu Asn Ala Ser Gly Ile Glu Ala Ile Leu Arg Asn

Leu Gln Pro Cys Leu Pro Ser Ala Thr Ala Tyr Val Glu Gly Gly

Gly Gly Ser Pro Gly Glu Pro Ser Gly Pro Ile Ser Thr Ile Asn

Pro Ser Pro Pro Ser Lys Glu Ser His Lys Ser Pro Asn Met Ala

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr Tyr Lys Leu Cys His Pro Glu Glu Leu Val Leu Leu Gly

His Ser Leu Gly Ile Pro Trp Ala Pro Leu Ser Ser Cys Pro Ser

Gln Ala Leu Gln Leu Ala Gly Cys Leu Ser Gln Leu His Ser Gly

Leu Phe Leu Tyr Gln Gly Leu Leu Gln Ala Leu Glu Gly Ile Ser

Pro Glu Leu Gly Pro Thr Leu Asp Thr Leu Gln Leu Asp Val Ala

Asp Phe Ala Thr Thr Ile Trp Gln Gln Met Glu Glu Leu Gly Met

Ala Pro Ala Leu Gln Pro

EXAMPLE 78
Construction of pMON31107

The new N-terminus/C-terminus gene in pMON31107 was created using Method III as described in Materials and Methods. The full length new N-terminus/C-terminus gene of hIL-3 receptor agonist pMON13416 was created and amplified from the intermediate plasmid, Syntan1, using the primer set 101 start (SEQ ID NO:362) and 100 rev (SEQ ID NO:363).

The resulting DNA fragment which contains the new gene was digested with restriction endonucleases NcoI and SnaBI. The digested The DNA fragment was resolved on a 1% TAE gel, stained with ethidium bromide and isolated using Geneclean.(Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL3 receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31107.

*E. coli* strain JM101 was transformed with pMON31107 for protein expression and protein isolation from inclusion bodies.

The plasmid, pMON31107, contains the DNA sequence of (SEQ ID NO:12) which encodes the following amino acid sequence:

Ala Gly Asp Trp Gln Glu Phe Arg Glu Lys Leu Thr Phe Tyr Leu (SEQ ID NO: 495)

Val Thr Leu Glu Gln Ala Gln Glu Gln Gln Gly Gly Gly Ser Asn

Cys Ser Ile Met Ile Asp Glu Ile Ile His His Leu Lys Arg Pro

Pro Ala Pro Leu Leu Asp Pro Asn Asn Leu Asn Asp Glu Asp Val

Ser Ile Leu Met Asp Arg Asn Leu Arg Leu Pro Asn Leu Glu Ser

Phe Val Arg Ala Val Lys Asn Leu Glu Asn Ala Ser Gly Ile Glu

Ala Ile Leu Arg Asn Leu Gln Pro Cys Leu Pro Ser Ala Thr Ala

Ala Pro Ser Arg His Pro Ile Ile Ile Lys Tyr Val Glu Gly Gly

Gly Gly Ser Pro Gly Glu Pro Ser Gly Pro Ile Ser Thr Ile Asn

Pro Ser Pro Pro Ser Lys Glu Ser His Lys Ser Pro Asn Met Ala

-continued

Thr Gln Gly Ala Met Pro Ala Phe Ala Ser Ala Phe Gln Arg Arg

Ala Gly Gly Val Leu Val Ala Ser His Leu Gln Ser Phe Leu Glu

Val Ser Tyr Arg Val Leu Arg His Leu Ala Gln Pro Ser Gly Gly

Ser Gly Gly Ser Gln Ser Phe Leu Leu Lys Ser Leu Glu Gln Val

Arg Lys Ile Gln Gly Asp Gly Ala Ala Leu Gln Glu Lys Leu Cys

Ala Thr Tyr Lys Leu Cys His Pro Glu Glu Leu Val Leu Leu Gly

His Ser Leu Gly Ile Pro Trp Ala Pro Leu Ser Ser Cys Pro Ser

Gln Ala Leu Gln Leu Ala Gly Cys Leu Ser Gln Leu His Ser Gly

Leu Phe Leu Tyr Gln Gly Leu Leu Gln Ala Leu Glu Gly Ile Ser

Pro Glu Leu Gly Pro Thr Leu Asp Thr Leu Gln Leu Asp Val Ala

Asp Phe Ala Thr Thr Ile Trp Gln Gln Met Glu Glu Leu Gly Met

Ala Pro Ala Leu Gln Pro

EXAMPLE 79
Construction of pMON31108

The new N-terminus/C-terminus gene in pMON31108 was created using Method III as described in Materials and Methods. The full length new N-terminus/C-terminus gene of hIL-3 receptor agonist pMON13416 was created and amplified from the intermediate plasmid, Syntan3, using the primer set 35 start (SEQ ID NO:356) and 34 rev (SEQ ID NO:357).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL3 receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform E. coli strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31108.

E. coli strain JM101 was transformed with pMON31108 for protein expression and protein isolation from inclusion bodies.

The plasmid, pMON31108, contains the DNA sequence of (SEQ ID NO:13) which encodes the following amino acid sequence:

Leu Asp Pro Asn Asn Leu Asn Asp Glu Asp Val Ser Ile Leu Met (SEQ ID NO: 496)

Asp Arg Asn Leu Arg Leu Pro Asn Leu Glu Ser Phe Val Arg Ala

Val Lys Asn Leu Glu Asn Ala Ser Gly Ile Glu Ala Ile Leu Arg

Asn Leu Gln Pro Cys Leu Pro Ser Ala Thr Ala Ala Pro Ser Arg

His Pro Ile Ile Ile Lys Ala Gly Asp Trp Gln Glu Phe Arg Glu

Lys Leu Thr Phe Tyr Leu Val Thr Leu Glu Gln Ala Gln Glu Gln

Gln Gly Gly Gly Ser Gly Gly Gly Ser Gly Gly Gly Ser Asn Cys

Ser Ile Met Ile Asp Glu Ile Ile His His Leu Lys Arg Pro Pro

Ala Pro Leu Tyr Val Glu Gly Gly Gly Gly Ser Pro Gly Glu Pro

Ser Gly Pro Ile Ser Thr Ile Asn Pro Ser Pro Pro Ser Lys Glu

Ser His Lys Ser Pro Asn Met Ala Thr Gln Gly Ala Met Pro Ala

Phe Ala Ser Ala Phe Gln Arg Arg Ala Gly Gly Val Leu Val Ala

Ser His Leu Gln Ser Phe Leu Glu Val Ser Tyr Arg Val Leu Arg

His Leu Ala Gln Pro Ser Gly Gly Ser Gly Gly Ser Gln Ser Phe

Leu Leu Lys Ser Leu Glu Gln Val Arg Lys Ile Gln Gly Asp Gly

```
Ala Ala Leu Gln Glu Lys Leu Cys Ala Thr Tyr Lys Leu Cys His

Pro Glu Glu Leu Val Leu Leu Gly His Ser Leu Gly Ile Pro Trp

Ala Pro Leu Ser Ser Cys Pro Ser Gln Ala Leu Gln Leu Ala Gly

Cys Leu Ser Gln Leu His Ser Gly Leu Phe Leu Tyr Gln Gly Leu

Leu Gln Ala Leu Glu Gly Ile Ser Pro Glu Leu Gly Pro Thr Leu

Asp Thr Leu Gln Leu Asp Val Ala Asp Phe Ala Thr Thr Ile Trp

Gln Gln Met Glu Glu Leu Gly Met Ala Pro Ala Leu Gln Pro
```

EXAMPLE 80
Construction of pMON31109

The new N-terminus/C-terminus gene in pMON31109 was created using Method III as described in Materials and Methods. The full length new N-terminus/C-terminus gene of hIL-3 receptor agonist pMON13416 was created and amplified from the intermediate plasmid, Syntan3, using the primer set 70 start (SEQ ID NO:358) and 69 rev (SEQ ID NO:359).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL3 receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31109.

*E. coli* strain JM101 was transformed with pMON31109 for protein expression and protein isolation from inclusion bodies.

The plasmid, pMON31109, contains the DNA sequence of (SEQ ID NO:14) which encodes the following amino acid sequence:

```
Asn Ala Ser Gly Ile Glu Ala Ile Leu Arg Asn Leu Gln Pro Cys (SEQ ID NO: 497)

Leu Pro Ser Ala Thr Ala Ala Pro Ser Arg His Pro Ile Ile Ile

Lys Ala Gly Asp Trp Gln Glu Phe Arg Glu Lys Leu Thr Phe Tyr

Leu Val Thr Leu Glu Gln Ala Gln Glu Gln Gln Gly Gly Gly Ser

Gly Gly Gly Ser Gly Gly Gly Ser Asn Cys Ser Ile Met Ile Asp

Glu Ile Ile His His Leu Lys Arg Pro Pro Ala Pro Leu Leu Asp

Pro Asn Asn Leu Asn Asp Glu Asp Val Ser Ile Leu Met Asp Arg

Asn Leu Arg Leu Pro Asn Leu Glu Ser Phe Val Arg Ala Val Lys

Asn Leu Glu Tyr Val Glu Gly Gly Gly Gly Ser Pro Gly Glu Pro

Ser Gly Pro Ile Ser Thr Ile Asn Pro Ser Pro Pro Ser Lys Glu

Ser His Lys Ser Pro Asn Met Ala Thr Gln Gly Ala Met Pro Ala

Phe Ala Ser Ala Phe Gln Arg Arg Ala Gly Gly Val Leu Val Ala

Ser His Leu Gln Ser Phe Leu Glu Val Ser Tyr Arg Val Leu Arg

His Leu Ala Gln Pro Ser Gly Gly Ser Gly Gly Ser Gln Ser Phe

Leu Leu Lys Ser Leu Glu Gln Val Arg Lys Ile Gln Gly Asp Gly

Ala Ala Leu Gln Glu Lys Leu Cys Ala Thr Tyr Lys Leu Cys His

Pro Glu Glu Leu Val Leu Leu Gly His Ser Leu Gly Ile Pro Trp

Ala Pro Leu Ser Ser Cys Pro Ser Gln Ala Leu Gln Leu Ala Gly
```

-continued

```
Cys Leu Ser Gln Leu His Ser Gly Leu Phe Leu Tyr Gln Gly Leu

Leu Gln Ala Leu Glu Gly Ile Ser Pro Glu Leu Gly Pro Thr Leu

Asp Thr Leu Gln Leu Asp Val Ala Asp Phe Ala Thr Thr Ile Trp

Gln Gln Met Glu Glu Leu Gly Met Ala Pro Ala Leu Gln Pro
```

EXAMPLE 81
Construction of pMON31110

The new N-terminus/C-terminus gene in pMON31110 was created using Method III as described in Materials and Methods. The full length new N-terminus/C-terminus gene of hIL-3 receptor agonist pMON13416 was created and amplified from the intermediate plasmid, Syntan3, using the primer set 91 start (SEQ ID NO:360) and 90 rev (SEQ ID NO:361).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL3 receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31110.

*E. coli* strain JM101 was transformed with pMON31110 for protein expression and protein isolation from inclusion bodies.

The plasmid, pMON31110, contains the DNA sequence of (SEQ ID NO:15) which encodes the following amino acid sequence:

```
Ala Pro Ser Arg His Pro Ile Ile Ile Lys Ala Gly Asp Trp Gln    (SEQ ID NO: 498)

Glu Phe Arg Glu Lys Leu Thr Phe Tyr Leu Val Thr Leu Glu Gln

Ala Gln Glu Gln Gln Gly Gly Ser Gly Gly Gly Ser Gly Gly

Gly Ser Asn Cys Ser Ile Met Ile Asp Glu Ile Ile His His Leu

Lys Arg Pro Pro Ala Pro Leu Leu Asp Pro Asn Asn Leu Asn Asp

Glu Asp Val Ser Ile Leu Met Asp Arg Asn Leu Arg Leu Pro Asn

Leu Glu Ser Phe Val Arg Ala Val Lys Asn Leu Glu Asn Ala Ser

Gly Ile Glu Ala Ile Leu Arg Asn Leu Gln Pro Cys Leu Pro Ser

Ala Thr Ala Tyr Val Glu Gly Gly Gly Gly Ser Pro Gly Glu Pro

Ser Gly Pro Ile Ser Thr Ile Asn Pro Ser Pro Pro Ser Lys Glu

Ser His Lys Ser Pro Asn Met Ala Thr Gln Gly Ala Met Pro Ala

Phe Ala Ser Ala Phe Gln Arg Arg Ala Gly Gly Val Leu Val Ala

Ser His Leu Gln Ser Phe Leu Glu Val Ser Tyr Arg Val Leu Arg

His Leu Ala Gln Pro Ser Gly Gly Ser Cly Gly Ser Gln Ser Phe

Leu Leu Lys Ser Leu Glu Gln Val Arg Lys Ile Gln Gly Asp Gly

Ala Ala Leu Gln Glu Lys Leu Cys Ala Thr Tyr Lys Leu Cys His

Pro Glu Glu Leu Val Leu Leu Gly His Ser Leu Gly Ile Pro Trp

Ala Pro Leu Ser Ser Cys Pro Ser Gln Ala Leu Gln Leu Ala Gly

Cys Leu Ser Gln Leu His Ser Gly Leu Phe Leu Tyr Gln Gly Leu

Leu Gln Ala Leu Glu Gly Ile Ser Pro Glu Leu Gly Pro Thr Leu

Asp Thr Leu Gln Leu Asp Val Ala Asp Phe Ala Thr Thr Ile Trp

Gln Gln Met Glu Glu Leu Gly Met Ala Pro Ala Leu Gln Pro
```

EXAMPLE 82

Construction of pMON31111

The new N-terminus/C-terminus gene in pMON31111 was created. using Method III as described in Materials and Methods. The full length new N-terminus/C-terminus gene of hIL-3 receptor agonist pMON13416 was created and amplified from the intermediate plasmid, Syntan3, using the primer set 101 start (SEQ ID NO:362) and 100 rev (SEQ ID NO:363).

The resulting DNA fragment which contains the new gene was digested with restriction endonucleases NcoI and SnaBI. The digested DNA fragment was resolved on a 1% TAE gel, stained with ethidium bromide and isolated using Geneclean (Bio101, Vista, Calif.). The purified digested DNA fragment was ligated into the expression vector pMON13189, using T4 DNA ligase (Boehringer Mannheim, Indianapolis, Ind.). The pMON13189 DNA had been previously digested with NcoI and SnaBI to remove the hIL3 receptor agonist pMON13416 coding sequence and the 4254 base pair vector fragment was isolated using Geneclean (Bio101, Vista, Calif.) after resolution on a 0.8% TAE gel and staining with ethidium bromide. A portion of the ligation reaction was used to transform *E. coli* strain DH5α cells (Life Technologies, Gaithersburg, Md.). Transformant bacteria were selected on ampicillin-containing plates. Plasmid DNA was isolated and sequenced to confirm the correct insert. The resulting plasmid was designated pMON31111.

*E. coli* strain JM101 was transformed with pMON31111 for protein expression and protein isolation from inclusion bodies. The plasmid, pMON31111, contains the DNA sequence of (SEQ ID NO:16) which encodes the following amino acid sequence:

```
Ala Gly Asp Trp Gln Glu Phe Arg Glu Lys Leu Thr Phe Tyr Leu  (SEQ ID NO: 499)
Val Thr Leu Glu Gln Ala Gln Glu Gln Gln Gly Gly Gly Ser Gly
Gly Gly Ser Gly Gly Gly Ser Asn Cys Ser Ile Met Ile Asp Glu
Ile Ile His His Leu Lys Arg Pro Pro Ala Pro Leu Leu Asp Pro
Asn Asn Leu Asn Asp Glu Asp Val Ser Ile Leu Met Asp Arg Asn
Leu Arg Leu Pro Asn Leu Glu Ser Phe Val Arg Ala Val Lys Asn
Leu Glu Asn Ala Ser Gly Ile Glu Ala Ile Leu Arg Asn Leu Gln
Pro Cys Leu Pro Ser Ala Thr Ala Pro Ser Arg His Pro Ile
Ile Ile Lys Tyr Val Glu Gly Gly Gly Ser Pro Gly Glu Pro
Ser Gly Pro Ile Ser Thr Ile Asn Pro Ser Pro Pro Ser Lys Glu
Ser His Lys Ser Pro Asn Met Ala Thr Gln Gly Ala Met Pro Ala
Phe Ala Ser Ala Phe Gln Arg Arg Ala Gly Gly Val Leu Val Ala
Ser His Leu Gln Ser Phe Leu Glu Val Ser Tyr Arg Val Leu Arg
His Leu Ala Gln Pro Ser Gly Gly Ser Gly Gly Ser Gln Ser Phe
Leu Leu Lys Ser Leu Glu Gln Val Arg Lys Ile Gln Gly Asp Gly
Ala Ala Leu Gln Glu Lys Leu Cys Ala Thr Tyr Lys Leu Cys His
Pro Glu Glu Leu Val Leu Leu Gly His Ser Leu Gly Ile Pro Trp
Ala Pro Leu Ser Ser Cys Pro Ser Gln Ala Leu Gln Leu Ala Gly
Cys Leu Ser Gln Leu His Ser Gly Leu Phe Leu Tyr Gln Gly Leu
Leu Gln Ala Leu Glu Gly Ile Ser Pro Glu Leu Gly Pro Thr Leu
Asp Thr Leu Gln Leu Asp Val Ala Asp Phe Ala Thr Thr Ile Trp
Gln Gln Met Glu Glu Leu Gly Met Ala Pro Ala Leu Gln Pro
```

EXAMPLE 83

Construction of pMON31112

Construction of pMON31112, a plasmid containing DNA sequence encoding a multi-functional hematopoietic receptor agonist which activates the hIL-3 receptor and G-CSF receptor. Plasmid, pMON13189 DNA was digested with restriction enzymes NcoI and XmaI resulting in an NcoI, XmaI vector fragment that was isolated and purified from a 0.8% agarose gel. The DNA from a second plasmid, pMON13222 (WO 94/12639, U.S. Ser. No. 08/411,796) was digested with NcoI and EcoRI resulting in a 281 base pair NcoI, EcoRI fragment. This fragment was isolated and purified from a 1.0% agarose gel. Two oligonucleotides SYNNOXA1.REQ (SEQ ID NO:350) and SYNNOXA2.REQ (SEQ ID NO:351) were annealed and ligated with the 281 base pair DNA fragment from pMON13222 to the DNA vector fragment from pMON13189. A portion of the ligation mixture was then transformed into *E. coli* K-12 strain JM101. Transformant bacteria were selected on ampicillin-containing plates. Plasmid DNA was isolated, analyzed by restriction analysis to show the presence of an EcoRV fragment, and sequenced to confirm the correct inserts.

The plasmid, pMON31112, contains the DNA sequence of (SEQ ID NO:37) which encodes the following amino acid sequence:
MetAlaAsnCysSerAsnMetIleAspGluIleIleThrHisLeuLys-GlnProProLeuProLeuLeuAspPheAsnAsnLeuAsnGlyGlu-AspGlnAspIleLeuMetAspAsnAsnLeuArgArgProAsnLeu-GluAlaPheAsnArgAlaValLysSerLeuGlnAsnAlaSerAlaIle-GluSerIleLeuLysAsnLeuLeuProCysLeuProLeuAlaThrAla-AlaProThrArgHisProIleHisIleLysAspGlyAspTrpAsnGlu-PheArgArgLysLeuThrPheTyrLeuLysThrLeuGluAsnAla-GlnAlaGlnGlnTyrValGluGlyGlyGlyGlySerProGlyGluPro-SerGlyProIleSerThrIleAsnProSerProProSerLysGluSerHis-LysSerProAsnMetAlaThrGlnGlyAlaMetProAlaPheAlaSer-AlaPheGlnArgArgAlaGlyGlyValLeuValAlaSerHisLeuGln-SerPheLeuGluValSerTyrArgvalLeuArgHisLeuAlaGlnPro-SerGlyGlySerGlyGlySerGlnSerPheLeuLeuLysSerLeuGlu-GlnValArgLysIleGlnGlyAspGlyAlaAlaLeuGlnGluLysLeu-CysAlaThrTyrLysLeuCysHisProGluGluLeuValLeuLeuGly-HisSerLeuGlyIleProTrpAlaProLeuSerSerCysProSerGln-AlaLeuGlnLeuAlaGlyCysLeuSerGlnLeuHisSerGlyLeu-PheLeuTyrGlnGlyLeuLeuGlnAlaLeuGluGlyIleSerProGlu-LeuGlyProThrLeuAspThrLeuGlnLeuAspValAlaAspPhe-AlaThrThrIleTrpGlnGlnMetGluGluLeuGlyMetAlaProAla-LeuGlnPro (SEQ ID NO:505)

Construction of pMON31113

Construction of pMON31113, a plasmid containing DNA sequence encoding a multi-functional hematopoietic receptor agonist which activates the hIL-3 receptor and G-CSF receptor. Plasmid, pMON13197 DNA was digested with restriction enzymes NcoI and XmaI resulting in an NcoI, XmaI vector fragment that was isolated and purified from a 0.8% agarose gel. The DNA from a second plasmid, pMON13239 (WO 94/12639, U.S. Ser. No. 08/411,796) was digested with NcoI and EcoRI resulting in a 281 base pair NcoI, EcoRI fragment. This fragment was isolated and purified from a 1.0% agarose gel. Two oligonucleotides SYNNOXA1.REQ (SEQ ID NO:350) and SYNNOXA2.REQ (SEQ ID NO:351) were annealed and ligated with the 281 base pair DNA fragment from pMON13239 to the DNA vector fragment from pMON13197. A portion of the ligation mixture was then transformed into E. coli K-12 strain JM101. Transformant bacteria were selected on ampicillin-containing plates. Plasmid DNA was isolated, analyzed by restriction analysis to show the presence of an EcoRV fragment, and sequenced to confirm the correct inserts.

The plasmid, pMON31113, contains the DNA sequence of (SEQ ID NO:38) which encodes the following amino acid sequence:
MetAlaAsnCysSerAsnMetIleAspGluIleIleThrHisLeuLys-GlnProProLeuProLeuLeuAspPheAsnAsnLeuAsnGlyGlu-AspGlnAspIleLeuMetGluAsnAsnLeuArgArgProAsnLeu-GluAlaPheAsnArgAlaValLysSerLeuGlnAsnAlaSerAlaIle-GluSerIleLeuLysAsnLeuLeuProCysLeuProLeuAlaThrAla-AlaProThrArgHisProIleIleIleArgAspGlyAspTrpAsnGlu-PheArgArgLysLeuThrPheTyrLeuLysThrLeuGluAsnAla-GlnAlaGlnGlnTyrValGluGlyGlyGlyGlySerProGlyGluPro-SerGlyProIleSerThrIleAsnProSerProProSerLysGluSerHis-LysSerProAsnMetAlaThrGlnGlyAlaMetProAlaPheAlaSer-AlaPheGlnArgArgAlaGlyGlyValLeuValAlaSerHisLeuGln-SerPheLeuGluValSerTyrArgValLeuArgHisLeuAlaGlnPro-ThrProLeuGlyProAlaSerSerLeuProGlnSerPheLeuLeuLys-SerLeuGluGlnValArgLysIleGlnGlyAspGlyAlaAlaLeuGln-GluLysLeuCysAlaThrTyrLysLeuCysHisProGluGluLeuVal-LeuLeuGlyHisSerLeuGlyIleProTrpAlaProLeuSerSerCys-ProSerGlnAlaLeuGlnLeuAlaGlyCysLeuSerGlnLeuHisSer-GlyLeuPheLeuTyrGlnGlyLeuLeuGlnAlaLeuGluGlyIleSer-ProGluLeuGlyProThrLeuAspThrLeuGlnLeuAspValAla-AspPheAlaThrThrIleTrpGlnGlnMetGluGluLeuGlyMetAla-ProAlaLeuGlnPro (SEQ ID NO:506)

EXAMPLE 85

Construction of pMON31114

Construction of pMON31114, a plasmid containing DNA sequence encoding a multi-functional hematopoietic receptor agonist which activates the hIL-3 receptor and G-CSF receptor. Plasmid, pMON13189 DNA was digested with restriction enzymes NcoI and XmaI resulting in an NcoI, XmaI vector fragment that was isolated and purified from a 0.8% agarose gel. The DNA from a second plasmid, pMON13239 (WO 94/12639, U.S. Ser. No. 08/411,796), was digested with NcoI and EcoRI resulting in a 281 base pair NcoI, EcoRI fragment. This fragment was isolated and purified from a 1.0% agarose gel. Two oligonucleotides SYNNOXA1.REQ (SEQ ID NO:350) and SYNNOXA2.REQ (SEQ ID NO:351) were annealed and ligated with the 281 base pair DNA fragment from pMON13239 to the DNA vector fragment from pMON13189. A portion of the ligation mixture was then transformed into E. coli K-12 strain JM101. Transformant bacteria were selected on ampicillin-containing plates. Plasmid DNA was isolated, analyzed by restriction analysis to show the presence of an EcoRV fragment, and sequenced to confirm the correct inserts.

The plasmid, pMON31114, contains the DNA sequence of (SEQ ID NO:39) which encodes the following amino acid sequence:
MetAlaAsnCysSerAsnMetIleAspGluIleIleThrHisLeuLys-GlnProProLeuProLeuLeuAspPheAsnAsnLeuAsnGlyGlu-AspGlnAspIleLeuMetGluAsnAsnLeuArgArgProAsnLeu-GluAlaPheAsnArgAlaValLysSerLeuGlnAsnAlaSerAlaIle-GluSerIleLeuLysAsnLeuLeuProCysLeuProLeuAlaThrAla-AlaProThrArgHisProIleIleIleArgAspGlyAspTrpAsnGlu-PheArgArgLysLeuThrPheTyrLeuLysThrLeuGluAsnAla-GlnAlaGlnGlnTyrValGluGlyGlyGlyGlySerProGlyGluPro-SerGlyProIleSerThrIleAsnProSerProProSerLysGluSerHis-LysSerProAsnMetAlaThrGlnGlyAlaMetProAlaPheAlaSer-AlaPheGlnArgArgAlaGlyGlyValLeuValAlaSerHisLeuGln-SerPheLeuGluValSerTyrArgValLeuArgHisLeuAlaGlnPro-SerGlyGlySerGlyGlySerGlnSerPheLeuLeuLysSerLeuGlu-GlnValArgLysIleGlnGlyAspGlyAlaAlaLeuGlnGluLysLeu-CysAlaThrTyrLysLeuCysHisProGluGluLeuValLeuLeuGly-HisSerLeuGlyIleProTrpAlaProLeuSerSerCysProSerGln-AlaLeuGlnLeuAlaGlyCysLeuSerGlnLeuHisSerGlyLeu-PheLeuTyrGlnGlyLeuLeuGlnAlaLeuGluGlyIleSerProGlu-LeuGlyProThrLeuAspThrLeuGlnLeuAspValAlaAspPhe-AlaThrThrIleTrpGlnGlnMetGluGluLeuGlyMetAlaProAla-LeuGlnPro (SEQ ID NO:507)

EXAMPLE 86

Construction of pMON31115

Construction of pMON31115, a plasmid containing DNA sequence encoding a multi-functional hematopoietic receptor agonist which activates the hIL-3 receptor and G-CSF receptor. Plasmid, pMON13197 DNA was digested with restriction enzymes NcoI and XmaI resulting in an NcoI, XmaI vector fragment that was isolated and purified from a 0.8% agarose gel. The DNA from a second plasmid, pMON13222, was digested with NcoI and EcoRI resulting in a 281 base pair NcoI, EcoRI fragment. This fragment was isolated and purified from a 1.0% agarose gel. Two oligonucleotides SYNNOXA1.REQ (SEQ ID NO:350) and SYNNOXA2.REQ (SEQ ID NO:351) were annealed and ligated with the 281 base pair DNA fragment from pMON13222 to the DNA vector fragment from pMON13197. A portion of the ligation mixture was then transformed into *E. coli* K-12 strain JM101. Transformant bacteria were selected on ampicillin-containing plates. Plasmid DNA was isolated, analyzed by restriction analysis to show the presence of an EcoRV fragment, and sequenced to confirm the correct inserts.

The plasmid, pMON31115, contains the DNA sequence of (SEQ ID NO:40) which encodes the following amino acid sequence:
MetAlaAsnCysSerAsnMetIleAspGluIleIleThrHisLeuLys-
GlnProProLeuProLeuLeuAspPheAsnAsnLeuAsnGlyGlu-
AspGlnAspIleLeuMetAspAsnAsnLeuArgArgProAsnLeu-
GluAlaPheAsnArgAlaValLysSerLeuGlnAsnAlaSerAlaIle-
GluSerIleLeuLysAsnLeuLeuProCysLeuProLeuAlaThrAla-
AlaProThrArgHisProIleHisIleLysAspGlyAspTrpAsnGlu-
PheArgArgLysLeuThrPheTyrLeuLysThrLeuGluAsnAla-
GlnAlaGlnGlnTyrValGluGlyGlyGlyGlySerProGlyGluPro-
SerGlyProIleSerThrIleAsnProSerProProSerLysGluSerHis-
LysSerProAsnMetAlaThrGlnGlyAlaMetProAlaPheAlaSer-
AlaPheGlnArgArgAlaGlyGlyValLeuValAlaSerHisLeuGln-
SerPheLeuGluValSerTyrArgvalLeuArgHisLeuAlaGlnPro-
ThrProLeuGlyProAlaSerSerLeuProGlnSerPheLeuLeuLys-
SerLeuGluGlnValArgLysIleGlnGlyAspGlyAlaAlaLeuGln-
GluLysLeuCysAlaThrTyrLysLeuCysHisProGluGluLeu-
ValLeuLeuGlyHisSerLeuGlyIleProTrpAlaProLeuSerSer-
CysProSerGlnAlaLeuGlnLeuAlaGlyCysLeuSerGlnLeu-
HisSerGlyLeuPheLeuTyrGlnGlyLeuLeuGlnAlaLeuGlu-
GlyIleSerProGluLeuGlyProThrLeuAspThrLeuGlnLeu-
AspValAlaAspPheAlaThrThrIleTrpGlnGlnMetGluGluLeu-
GlyMetAlaProAlaLeuGlnPro (SEQ ID NO:508)

EXAMPLE 87
Determination of the In Vitro Activity of Multi-Functional Hematopoietic Receptor Agonist Proteins The protein concentration of the multi-functional hematopoietic receptor agonist protein can be determined using a sandwich ELISA based on an affinity purified polyclonal antibody. Alternatively the protein concentration can be determined by amino acid composition analysis. The bioactivity of the multi-functional hematopoietic receptor agonist can be determined in a number of in vitro assays. For example a multi-functional hematopoietic receptor agonist which binds the hIL-3 receptor and G-CSF receptor can be assayed in cell proliferation assays using cell lines expressing the hIL-3 and/or G-CSF receptors. One such assay is the AML-193 cell proliferation assay. AML-193 cells respond to IL-3 and G-CSF which allows for the combined bioactivity of the IL-3/G-CSF multi-functional hematopoietic receptor agonist to be determined. Another such assay is the TF1 cell proliferation assay.

In addition other factor dependent cell lines, such as M-NFS-60 (ATCC. CRL 1838) or 32D which are murine IL-3 dependent cell line, may be used. The activity of IL-3 is species specific whereas G-CSF is not, therefore the bioactivity of the G-CSF component of the IL-3/G-CSF multi-functional hematopoietic receptor agonist can be determined independently. Cell lines, such as BHK or murine Baf/3, which do not express the receptor for a given ligand can be transfected with a plasmid containing a gene encoding the desired receptor. An example of such a cell line is BaF3 transfected with the hG-CSF receptor (BaF3/hG-CSF). The activity of the multi-functional hematopoietic receptor agonist in these cell lines can be compared with hIL-3 or G-CSF alone or together. The bioactivity of examples of multi-functional hematopoietic receptor agonists of the present invention assayed in the BaF3/hG-CSF cell proliferation and TF1 cell proliferation assays is shown in Table 5 and Table 6. The bioactivity of the multi-functional hematopoietic receptor agonist is expressed as relative activity compared with a standard protein pMON13056 (WO 95/21254) which has IL-3 and G-CSF receptor binding activity. The bioactivity of examples of multi-functional hematopoietic receptor agonists of the present invention assayed in the BaF3/c-mpl cell proliferation and TF1 cell proliferation assays is shown in Table 7 and Table 8.

TABLE 5

CELL PROLIFERATIVE ACTIVITY
OF DUAL IL-3/G-CSF RECEPTOR AGONISTS

| pMON | BaF3/hG-CSF receptor cell proliferation assay relative activity | TF1 cell proliferation assay relative activity* |
|---|---|---|
| 13182 | 0.015 | 1.1 |
| 13183 | 0.02 | nd |
| 13184 | 0.01 | 0.3 |
| 13185 | 0.023 | 0.36 |
| 13186 | 0.36 | 0.45 |
| 13187 | 0.07 | 0.26 |
| 13188 | 0.64 | 1.3 |
| 13189 | 0.58 | 1.37 |
| 13190 | 0.045 | 1.2 |
| 13191 | 0.14 | 2.7 |
| 13192 | 0.09 | 2.2 |
| 13193 | 0.06 | 3.0 |
| 25190 | nd | nd |
| 25191 | 0.43 | 1.2 |
| 13194 | nd | nd |
| 13195 | 1.3 | 4.3 |
| 13196 | 0.66 | 0.5 |
| 13197 | 0.6 | 0.77 |
| 13198 | 0.6 | 0.5 |
| 13199 | nd | nd |
| 15982 | 0.7 | 1.9 |
| 15981 | 0.068 | 1.2 |
| 15965 | 0.7 | 0.82 |
| 15966 | 0.36 | 1.48 |
| 15967 | 0.62 | 1.37 | nd = not determined
*The bioactivity of the multi-functional hematopoietic receptor agonist is expressed as relative activity compared with a standard protein pMON13056. n = 3 or greater

TABLE 6

CELL PROLIFERATIVE ACTIVITY
OF DUAL IL-3/G-CSF RECEPTOR AGONISTS

| pMON | BaF3/hG-CSF receptor cell proliferation assay relative activity | TF1 cell proliferation assay relative activity |
|---|---|---|
| 31104 | + | + |
| 31105 | + | + |
| 31106 | + | + |
| 31107 | nd | nd |
| 31108 | + | + |
| 31109 | + | + |
| 31110 | nd | nd |
| 31111 | nd | nd |
| 31112 | + | + |
| 31113 | + | + |
| 31114 | + | + |
| 31115 | + | + |
| 31116 | nd | nd |
| 31117 | nd | nd | nd = not determined
†The bioactivity (n = 1 or 2) of the multi-functional hematopoietic receptor agonist is expressed as relative activity compared with a standard protein pMON13056.
"+" indicates that the molecule was comparable to pMON13056.

TABLE 7

CELL PROLIFERATION ACTIVITY

| pMON | Baf3/c-mpl receptor cell proliferation assay activity* | TF1 cell proliferation assay activity |
|---|---|---|
| 28505 | − | + |
| 28506 | − | + |
| 28507 | − | + |
| 28508 | − | + |
| 28509 | − | + |
| 28510 | − | + |
| 28511 | + | + |
| 28512 | + | + |
| 28513 | + | + |
| 28514 | + | + |
| 28519 | − | + |
| 28520 | − | + |
| 28521 | − | + |
| 28522 | − | + |
| 28523 | − | + |
| 28524 | − | + |
| 28525 | + | + |
| 28526 | + | + |
| 28533 | − | + |
| 28534 | − | + |
| 28535 | − | + |
| 28536 | − | + |
| 28537 | − | + |
| 28538 | − | + |
| 28539 | + | + |
| 28540 | + | + |
| 28541 | + | + |
| 28542 | + | + |
| 28543 | + | + |
| 28544 | + | + |
| 28545 | + | + |

*Activity measured in the Baf3 cell line transfected with the c-mpl receptor, relative to c-mpl ligand (1–153).
†Activity measured relative to pMON13056.

In a similar manner other factor dependant cell lines known to those skilled in the art can be used to measure the bioactivity of the desired multi-functional hematopoietic receptor agonist. The methylcellulose assay can be used to determine the effect of the multi-functional hematopoietic receptor agonists on the expansion of the hematopoietic progenitor cells and the pattern of the different types of hematopoietic colonies in vitro. The methylcellulose assay can provide an estimate of precursor frequency since one measures the frequency of progenitors per 100,000 input cells. Long term, stromal dependent cultures have been used to delineate primitive hematopoietic progenitors and stem cells. This assay can be used to determine whether the multi-functional hematopoietic receptor agonist stimulates the expansion of very primitive progenitors and/or stem cells. In addition, limiting dilution cultures can be performed which will indicate the frequency of primitive progenitors stimulated by the multi-functional hematopoietic receptor agonist.

TABLE 8

| pMON # | IL-3 agonist activity (AML cell proliferation assay) | c-mol receptor agonist activity (Baf/3-c-mpl cell proliferation assay |
|---|---|---|
| 28505 | + | − |
| 28506 | + | − |
| 28507 | + | − |
| 28508 | + | − |
| 28509 | + | − |
| 28510 | + | − |
| 28511 | + | + |
| 28512 | + | + |
| 28513 | + | + |
| 28514 | + | + |
| 28515 | + | + |
| 28519 | + | − |
| 28520 | + | − |
| 28521 | + | − |
| 28522 | + | − |
| 28523 | + | − |
| 28524 | + | − |
| 28525 | + | + |
| 28526 | + | + |
| 28527 | + | + |
| 28528 | + | + |
| 28529 | + | + |
| 28535 | + | − |
| 28539 | + | + |
| 28540 | + | + |
| 28541 | + | + |
| 28542 | + | + |
| 28545 | + | + |
| 28551 | + | + |
| 28571 | + | + |

EXAMPLE 88

G-CSF variants which contain single or multiple amino acid substitutions were made using PCR mutagenesis techniques as described in WO 94/12639 and WO 94/12638. These and other variants (i.e. amino acid substitutions, insertions or deletions and N-terminal or C-terminal extensions) could also be made, by one skilled in the art, using a variety of other methods including synthetic gene assembly or site-directed mutagenesis (see Taylor et al., Nucl. Acids Res., 13: 7864–8785 [1985]; Kunkel et al., Proc. Natl. Acad. Sci. USA, 82: 488–492 [1985]; Sambrook et al., Molecular Cloning: A Laboratory Manual, 2nd ed., Cold Spring Harbor Laboratory Press, Cold Spring Harbor, N.Y., [1989], (WO 94/12639) and (WO 94/12638)). These substitutions can be made one at a time or in combination with other amino acid substitutions, and/or deletions, and/or insertions and/or extensions. After sequence verification of the changes, the plasmid DNA can be transfected into an appropriate mammalian cell, insect cell or bacterial strain such as E. coli for production. Known variants of G-CSF, which are active, include substitutions at positions 1 (Thr to Ser, Arg or Gly, 2 (Pro to Leu), 3 (Leu to Arg or Ser) and 17 (Cys to Ser) and deletions of amino acids 1–11 (Kuga et al. Biochemicla and Biophysical Research Comm. 159:103–111 (1989)). These G-CSF amino acid substitution variants can be used as the template to create the G-CSF receptor agonists in which a new N-terminus and new C-terminys are created. Examples of G-CSF amino acid substitution variants are shown in Table 9.

EXAMPLE 89

Bioactivity Determination of G-CSF Amino Acid Substitution Variants

The G-CSF amino acid substitution variants can be assayed for cell proliferation activity using the Baf/3 cell line transfected with the human G-CSF receptor. The bioactvity of examples of G-CSF amino acid substitution variants is shown in Table 9 relative to native human G-CSF. A "+" indicates a comparable activity to native and a "−" indicates significantly reduced or no measurable activity.

TABLE 9

CELL PROLIFERATION ACTIVITY OF G-CSF VARIANTS IN BAF3 CELL LINE TRANSFECTED WITH THE HUMAN G-CSF RECEPTOR

| aa position | native aa | mutant aa | activity * |
|---|---|---|---|
| 13 | Phe | Ser | + |
| 13 | Phe | His | + |
| 13 | Phe | Thr | + |
| 13 | Phe | Pro | + |
| 16 | Lys | Pro | + |
| 16 | Lys | Ser | + |
| 16 | Lys | Thr | + |
| 16 | Lys | His | + |
| 18 | Leu | Pro | + |
| 18 | Leu | Thr | + |
| 18 | Leu | His | + |
| 18 | Leu | Cys | + |
| 18 | Leu | Ile | + |
| 19 | Glu | Ala | − |
| 19 | Glu | Thr | − |
| 19 | Glu | Arg | − |
| 19 | Glu | Pro | − |
| 19 | Glu | Leu | − |
| 19 | Glu | Ser | − |
| 22 | Arg | Tyr | + |
| 22 | Arg | Ser | + |
| 22 | Arg | Ala | + |
| 22 | Arg | Thr | + |
| 24 | Ile | Pro | + |
| 24 | Ile | Leu | + |
| 24 | Ile | Tyr | + |
| 27 | Asp | Gly | + |
| 30 | Ala | Ile | + |
| 30 | Ala | Leu | + |
| 34 | Lys | Ser | + |
| 43 | His | Gly | + |
| 43 | His | Thr | + |
| 43 | His | Val | + |
| 43 | His | Lys | + |
| 43 | His | Trp | + |
| 43 | His | Ala | + |
| 43 | His | Arg | + |
| 43 | His | Cys | + |
| 43 | His | Leu | + |
| 44 | Pro | Arg | + |
| 44 | Pro | Asp | + |
| 44 | Pro | Val | + |
| 44 | Pro | Ala | + |
| 44 | Pro | His | + |
| 44 | Pro | Gln | + |
| 44 | Pro | Trp | + |
| 44 | Pro | Gly | + |
| 44 | Pro | Thr | + |
| 46 | Glu | Ala | + |
| 46 | Glu | Arg | + |
| 47 | Leu | Thr | + |
| 49 | Leu | Phe | + |
| 49 | Leu | Arg | + |
| 49 | Leu | Ser | + |
| 50 | Leu | His | + |
| 54 | Leu | His | + |
| 67 | Gln | Lys | + |
| 67 | Gln | Leu | + |
| 67 | Gln | Cys | + |
| 70 | Gln | Pro | + |
| 70 | Gln | Leu | + |
| 70 | Gln | Arg | + |
| 70 | Gln | Ser | + |
| 104 | Asp | Gly | + |
| 104 | Asp | Val | + |
| 108 | Leu | Ala | + |
| 108 | Leu | Val | + |
| 108 | Leu | Arg | + |
| 108 | Leu | Gly | + |
| 108 | Leu | Trp | + |

TABLE 9-continued

CELL PROLIFERATION ACTIVITY OF G-CSF VARIANTS IN BAF3 CELL LINE TRANSFECTED WITH THE HUMAN G-CSF RECEPTOR

| aa position | native aa | mutant aa | activity * |
|---|---|---|---|
| 108 | Leu | Gln | + |
| 115 | Thr | His | + |
| 115 | Thr | Leu | + |
| 115 | Thr | Ala | + |
| 144 | Phe | His | + |
| 144 | Phe | Arg | + |
| 144 | Phe | Pro | + |
| 144 | Phe | Leu | + |
| 144 | Phe | Glu | + |
| 146 | Arg | Gln | + |
| 147 | Arg | Gln | + |
| 156 | His | Asp | − |
| 156 | His | Ser | + |
| 156 | His | Gly | + |
| 159 | Ser | Arg | + |
| 159 | Ser | Thr | + |
| 159 | Ser | Tyr | + |
| 159 | Ser | Val | + |
| 159 | Ser | Gly | + |
| 162 | Glu | Gly | − |
| 162 | Glu | Trp | + |
| 162 | Glu | Leu | + |
| 163 | Val | Arg | + |
| 163 | Val | Ala | + |
| 163 | Val | Gly | + |
| 165 | Tyr | Cys | nd |
| 169 | Ser | Leu | + |
| 169 | Ser | Cys | + |
| 169 | Ser | Arg | + |
| 170 | His | Arg | + |
| 170 | His | Ser | + |

* activity relative to native hG-CSF
nd = not determined

EXAMPLE 90

Isolation of CDNA Encoding flt3 Ligand

Three flt3 ligand clones were amplified from human bone morrow poly A+RNA (Clontech) using NCOFLT, HIND160, and HIND165 PCR primers (according to the manufacturer's suggested conditions). These amplified PCR products were gel purified and cloned into the BHK expression vector pMON5723 generating pMON30237 (NCOFLT+HIND160), pMON30238 (NCOFLT+HIND165), and a deletion clone pMON30239 (NCOFLT+HIND165). The deletion in pMON30239 is of amino acid residues 89 through 106.

EXAMPLE 91

Sequence rearranged flt3 receptor agonists were constructed using several methods and linker types. The first set of constructs containing the linker peptide (SerGlyGlyAsnGly)X (where X=1, 2, or 3) with the breakpoints 39/40, 65/66, and 89/90 were made using a two step PCR process described by Mullins et al. in which the front half and the back half of each final sequence rearranged molecule is made separately in the first PCR step, then the paired products of the first reaction step are combined in a second PCR step and extended in the absence of exogenous primers. For example, to make the three 89/90 breakpoint precursor molecules with SerGlyGlyAsnGly SEQ ID NO:786, SerGlyGlyAsnGlySerGlyGlyAsnGly SEQ ID NO:787, and SerGlyGlyAsnGlySerGlyGlyAsnGlySerGlyGlyAsnGly SEQ ID NO:788 amino acid linkers (pMON32326, pMON32327 and pMON32328 respectively), six initial PCR products were generated. The following primer pairs were used in the first step PCR reaction: a) 89For/L5B; b) 89For/L10B; c) 89For/L15B; d) 89Rev/L5A; e) 89Rev/L10A; and f) 89Rev/L15A. The identical approach was used to make pMON32321 (39/40 breakpoint, primer pairs 39For/L10B and 39Rev/L10A) and pMON32325 (65/66 breakpoint, primer pairs 65For/L5B and 65Rev/L5A) precursors. Except as noted below, all subsequent PCR reactions utilized the components of the PCR Optimizer Kit (Invitrogen) and amplification conditions according to the manufacturers suggested protocol. Reactions were set up as follows: 50 pmol of each primer, 10 ul of 5× Buffer B [300 mM Tris-HCl (pH 8.5), 10 mM $MgCl_2$, 75 mM $(NH_4)2SO_4$], 5 U Taq polymerase, and 100 ng of heat denatured DNA (in this example pMON30238) template were combined, and brought to 45 ul final volume with $dH_2O$. Reactions were preincubated for 1–5 minute at 80° C., then 5 ul of 10 mM dNTP added to each reaction, and heat denatured for 2 minutes at 94° C. prior to amplification in a Perkin Elmer model 480 DNA thermal cycler. Seven DNA amplification cycles were done under the following conditions: heat denature for one minute at 94° C., two minutes annealing at 65° C., followed by a three minute extension at 72° C. Twenty three additional cycles consisting of a one minute heat denaturation at 94° C. followed by a four minute annealing/extension at 72° C. were done, followed by a final 7 minute extension cycle at 72° C. With the exception of pMON32328, the PCR amplification products were run out on a 1.2% TAE agarose gel, and the appropriate size bands (the major amplification product) were excised and purified using Geneclean II (Bio 101). Samples were resuspended in 10 ul $dH_2O$. The amplication products for pMON32328 were purifed directly using a Wizard PCR Clean UP kit (Promega), and DNA eluted in 50 ul $dH_2O$.

The method to construct the precursors of pMON32322 (39/40 breakpoint, primer pairs 39For/L5B and 39Rev/L5A) was modified by increasing the amount of template to 1 ug, and by changing the PCR amplification conditions as follows: six cycles of 94° C., 1 minute, 65° C. for 2 minute, and 72° C. for 2½ minutes, followed by 15 cycles of 94° C. for 1 minute, 70° C. for 2 minutes, and 72° C. for 2 minutes, followed by a single 72° C. extension cycle for seven minutes.

The second PCR step utilized the gel-purified precursors from the first PCR step as a combination of primer/template as follows: 5 ul each of each precursor molecule (i.e. for pMON32328 the PCR products from primer pairs 89For/L5B and 89Rev/L5A), 10 ul of 5× Buffer B, 5 U of Taq polymerase, and 24 ul $dH_2O$. The reactions were heated for five minutes at 80° C., 5 ul of 10 mM dNTP was added, and the reactions heat denatured for 94° C. for two minutes. DNA amplification conditions were as follows: 15 cycles of 94° C. for one minute, 69° C. for two minutes, followed then by a three minute extension at 72° C. To allow for complete extension, the last cycle was followed by a single extension step at 72° C. for seven minutes. The 80 deg incubation time was reduced to two minutes and the number of cycles was decreased to ten cycles for pMON32325 (PCR products 65For/L5B and 65Rev/L5A). PCR reaction products of the appropriate size were gel purified on a 1.2% TAE agarose gel using Geneclean II. For pMON32322 (39For/L5B and 39Rev/L5A) the annealing temperature was reduced to 68° C., and the extension time reduced to two minutes. In addition, the PCR product was purified using a Wizard PCR Clean Up kit (Promega) according to the suppliers suggested protocol. The second PCR step was modified for pMON32326 (PCR products of 89For/L15B and 89Rev/L15A) as follows. Three sets of PCR reactions were set up identically as above, except for the sample buffer type (either 5× buffer B, D, or J—PCR Optimizer Kit). Composition of buffers D and J differ from buffer B only by pH or $[MgCl_2]$. The $[MgCl_2]$ for buffer D is 3.5 mM, whereas the pH of buffer J is 9.5. The protocol was modified by increasing the number of PCR cycles 20, and 15 ul aliquots were withdrawn at the end of cycles 10, 15 and 20. Five uls of each aliquot timepoint were analyzed for the presence of amplfied material on a 1.2% TBE agarose gel. The remainder of the buffer B, D, and J PCR reaction mixtures were pooled and subsequently purified using the Wizard PCR Clean Up Kit protocol. The DNA was eluted in 50 ul $dH_2O$.

The purified samples from the second step PCR reaction were digested with NcoI/HindIII using one of two standardized digestion conditions. For Geneclean II purified samples, 10 ul of DNA were digested in a 20 ul reaction with 7.5 U each of NcoI/HindIII for two hours at 37° C., and gel purified on a 1.1% TAE agarose gel again with Geneclean II. Ligation-ready samples were resuspended in 10 ul $dH_2O$. For pMON32322, 20 ul of sample was digested in a 50 ul reaction volume with 20 U each of NcoI and HindIII for 3 hour at 37° C. 0.1 volume 3M NaOAc (pH 5.5) and 2.5 volume of EtOH were added, mixed, and stored at −20° C. overnight. The DNA was recovered by pelleting for 20 minutes at 13,000 rpm @ 4° C. in a Sigma Mk 202 microfuge. The DNA pellet was rinsed with chilled 70% EtOH, lyophilized, and resuspended in 10 ul $dH_2O$.

EXAMPLE 92

An alternate approach was used to construct pMON32320 (39/40 breakpoint, fifteen amino acid linker), pMON32323 (65/66 breakpoint, fifteen AA linker), and pMON32324 (65/66 breakpoint, ten amino acid linker). New primers (L15C, L15D, L15E) were designed to incorporate BamHI restriction site in the primer that was inframe to allow cloninng into the BamHI site and maintain the proper reading frame. PCR reaction conditions for the first step were performed identically to that described for pMON32322, except that the following set of primer pairs were used: 65For/L15D and 65Rev/L15E (pMON32324); 39For/L15D and 39Rev/L15C (pMON32320); and 65For/L15D and 65Rev/L15C (pMON32323). The PCR reaction products were purified using a Wizard PCR Clean Up kit as described, and eluted in 50 ul $dH_2O$. Samples were digested with either NcoI/BamHI (39For/L15D and 65For/L15D) or BamHI/HindIII (39Rev/L15C, 65Rev/L15C, and 65Rev/L15E). Restriction digests were performed as follows: 10 ul of purified PCR reaction products, 3 ul of 10× universal restriction buffer, 15 U of either NcoI or HindIII, 15 U of BamHI, in a final reaction volume of 30 ul. Reactions were incubated for 90 minutes at 37° C., and the PCR products gel purified on a 1.1% TAE agarose gel using Geneclean II. Ligation-ready DNA was resuspended in 10 ul $dH_2O$.

Inserts were ligated to NcoI/HindIII digested pMON3977 (BHK mammalian expression vector) that had been treated with shrimp alkaline phosphatase (SAP) either in a three way (pMON32320, pMON32323, or pMON32324) or a two way (pMON32321, pMON32322, pMON32325, pMON32326, pMON32327 and pMON32328) ligation reaction as follows: 2.5 ul of insert (2 ul of each primer pair amplicon for pMON32320, pMON32323, and pMON32324) was added to 50 ng of vector in a ten ul reaction using standard ligation conditions. Two ul of each reaction was transformed with 100 ul of chemically competent DH5α cells (Gibco/BRL) following the manufacturers suggested protocol. Twenty five ul and 200 ul aliquots were plated out on LB plates containing 50 ug/ml ampicillin and incubated overnight. Isolated colonies were picked and DNA prepared from 50 ml overnight cultures using Qiagen DNA midiprep kits. DNA was quantitated by absorbance at A260/A280, and verified for correct insert size by agarose gel electrophoresis following digestion of 1 ug template with NcoI/HindIII restriction endonucleases. Samples containing inserts of the predicted size were sequenced in both orientations using vector-specific primers using an automated fluorescent DNA sequencer model 373A (Perkin Elmer ABI). Sequencing reactions were done in 20 ul reaction volumes using a Perkin Elmer model 480 DNA thermal cycler as follows: one ug of template, 3.2 pmol primer, 1 ul DMSO, 9.5 ul Taq terminator dyedeoxy premix (Perkin Elmer ABI) were combined, and subjected to 25 cycles of sequencing amplification as follows: 30 seconds at 94° C., 15 second annealing at 50° C., followed by a four minute extension cycle at 60° C. Samples were purified using Centri-Sep spin columns (Princeton Separations) following the manufacturers suggested protocol, lyophized, and submitted for sequence analysis. Samples containing the predicted amino acid sequence were selected for analysis and assigned pMONnumbers.

EXAMPLE 93

A similar approach used to construct pMON32320, pMON32323, and pMON32324 was utilized to introduce the second linker type (SerGlyGlySerGly)X where x=2 or 3, into two sequence rearranged sequences containing the 39/40 breakpoint (pMON32348 and 32350). The primer pairs were as follows: for pMON32348 the combinations of 339For2/339Rev3 and 339Rev2/339-10For3 and for pMON32350 the combinations of 339For2/339Rev3 and 339Rev2/339-15For3 were used to create three PCR amplification products. Each PCR amplification was set up as follows: to 100 ng of heat denatured pMON32320, 50 pmol of each primer pair, 10 ul of 5× Buffer B, 5 U of Taq polymerase and dH$_2$O was added to a final volume of 45 ul. Reactions were preincubated as described before. Fifteen amplification cycles were done under the following conditions: heat denature at 94° C., one minute, followed by a two minute annealing step at 70° C., and a three minute extension at 72° C. After the last cycle, a single 72 deg extension step of 7 minutes was done. The PCR amplification products of primer pairs 339For2/339Rev3, 339Rev2/339-10For3, and 339Rev2/339-15For2 were purified using a Wizard PCR Clean Up kit (Promega), and eluted in 50 ul dH$_2$O. NcoI/BamHI digests for the 339For2/339Rev3 primer pair as follows: 8 ul of DNA template was mixed with 2 ul universal restriction buffer and 10 U each of NcoI and BamHI in a 20 ul reaction volume, and incubated for 90 minutes at 37° C. The digestion products was purified using the Geneclean II direct purification protocol, and ligation ready DNA resuspended in 10 ul dH$_2$O. The restriction digests and subsequent purification for the 339Rev2/339-10For3 and 339Rev2/339-15For2 amplification products were done identically as described for the 339For2/339Rev3 amplicon, except that 10 U of HindIII was substituted for NcoI. Standard ligations were done by adding to 50 ng NcoI/HindIII/SAP-treated, gel purified pMON3977, 0.5 ul 339For2/Rev3 amplicon, 1 ul of either 339Rev2/339-10For3 (pMON32348) or 339Rev2/339-15For3 (pMON32350) amplicons, 5 U T4 DNA ligase, and 1 ul 10× ligase buffer in a 10 ul reaction volume for 60 minutes at ambient temperature. Subsequent steps leading to final DNA sequence confirmation were done as described above.

EXAMPLE 94

A third type of linker, with a variable (GlyGlyGlySer)X repeat motif, was incorporated into another set of sequence rearranged flt3 receptor agonists from modularly constructed templates. These linker lengths were; 6 AA linker (GlyGlyGlySerGlyGly SEQ ID NO:792), 7 AA linker (GlyGlyGlySerGlyGlyGly SEQ ID NO:793), 10 AA linker (GlyGlyGlySerGlyGlyGlySerGlyGly SEQ ID NO:794), 13 AA linker (GlyGlyGlySerGlyGlyGlySerGlyGlyGlySerGly SEQ ID NO:795), 15 AA linker (GlyGlyGlySerGlyGly-GlySerGlyGlyGlySerGlyGlyGly SEQ ID NO:796); and 21 AA linker (GlyGlyGlySerGlyGlyGlySerGlyGlyGlySer-GlyGlyGlySerGlyGly GlySerGly SEQ ID NO:797) amino acid residues. These modular templates, each comprising a dimer of hflt3 ligand separated by a BamHI-containing linker of unique length, were constructed as follows. Six intermediate PLASMID templates, FL3N, FL7N, FL11N, FL3C, FL4C, and FL10C, were constructed by PCR using paired primers and pMON30238 as template using cycling conditions similar to those employed for pMON32322. Per reaction, 50 pmol of each primer was added to 100 ng of heat-denatured template and the reactions assembled as described for pMON32322. Cycle conditions were as follows: seven cycles of 94° C., one minute; two minutes at 65° C., and 2.5 minutes at 72° C.; followed by ten cycles of one minute at 94° C., two minutes at 70° C., and 2.5 minutes at 72° C. A single seven minute extension at 72° C. completed the cycling reactions. The primer pairs used to construct each intermediate were; N-term/FLN3 (FL3N); N-term/FLN7 (FL7N); N-term/FLN11 (FL11N); C term/FLC3 (FL3C); C-term/FLC4 (FL4C); and C-term/FLC10 (FL10C). The PCR amplification products were purified with Wizard PCR Clean Up kits (Promega) and eluted in 50 ul dH$_2$O. Purified DNA for the first subset, FL3N, FL7N, and FL11N, were digested with NcoI/BamHI, gel purified as described previously, and ligated to NcoI/BamHI/Sap-treated pSE420 vector DNA (Invitrogen). Intermediate templates of the second subset, FL3C, FL4C, and FL10C, were constructed in an identical manner except HindIII was utilized instead of NcoI. Subsequent steps leading to final DNA sequence confirmation were done as described above.

EXAMPLE 95

To make the final six templates, the two subsets of intermediates in pSE420 were digested with either NcoI/BamHI (FL3N, FL7N, FL11N-subset 1) or BamHI/HindIII (FL3C, FL4C, FL10C-subset 2) and gel purified using Geneclean II as described previously. One intermediate amplicon from each subset were ligated to NcoI/HindIII/SAP-treated pMON3977 per reaction and transformed in DH5α cells as described previously using the following combinations to generate specific linker lengths: six AA linker (FL3N and FL3C), seven AA linker (FL3N and FL4C), ten AA linker (FL7N and FL3C), thirteen AA linker (FL3N and FL10C), fifteen AA linker (FL11N and FL4C), and 21 AA linker (FL11N and FL10C). DNA was prepared 50 ml overnight cultures from single colonies from each of the six combination as described above, analyzed for correct insert size by NcoI/HindIII restriction analysis, and used as template. Primer pairs 39For/39Rev (39/40 breakpoint); 65For/65Rev (65/66 breakpoint) and 89For/89Rev (89/90 breakpoint) were used to PCR amplify each templates as described for pMON32322, except 75 pmol of each primer was used. Amplification conditions were modified as follows: six cycles of 94° C. for one minute, 2 minutes at 70° C., 2.5 minutes at 72° C.; followed by nine cycles of 94° C. for one minute, and three minutes at 72° C. After the last cycle, a final extension of six minutes at 72° C. allowed ample time for full extension of products. Samples were purified using a Wizard PCR Clean Up kit as described, and double digested with NcoI/HindIII. These amplification products were purified again using a Wizard PCR Clean Up kit. In addition, all six different linker length molecules for the 39/40 breakpoint were cloned into NcoI/HindIII/SAP-treated pMON3977 as single proteins (pMON32365, pMON32366, pMON32367, pMON32368, pMON32369 and 32370). Subsequent steps leading to final DNA sequence confirmation were done as described above.

EXAMPLE 96

Genes encoding multi-functional chimeric receptor agonist molecules consisting of an IL-3 receptor agonist, of pMON13416 (WO 94/12638) joined via an IgG2b linker to either native flt3 ligand or sequence rearranged flt3 receptor agonists, Examples 91–93, were constructed. Inserts containing the desired sequence rearranged flt3 receptor agonists molecule were isolated from the parental plasmid as a NcoI/HindIII restriction fragment and ligated to pMON30304 digested with AflIII/Hind III/SAP Subsequent steps leading to final DNA sequence confirmation were done as described above. The resulting plasmids, containing the DNA sequences encoding multi-functional chimeric molecules comprising an IL-3 receptor agonist (from pMON13416) and a sequence rearranged flt3 receptor agonist are indicated in Table 9.

TABLE 9

| Resulting Plasmid | hflt3 ligand permutein precursors |
| --- | --- |
| pMON30247 | pMON30237 |
| pMON30248 | pMON30238 |
| pMON32332 | pMON32321 |
| pMON32333 | pMON32320 |
| pMON32334 | pMON32325 |
| pMON32335 | pMON32324 |
| pMON32336 | pMON32323 |
| pMON32337 | pMON32328 |
| pMON32338 | pMON32327 |
| pMON32339 | pMON32326 |

EXAMPLE 97

Genes encoding multi-functional chimeric receptor agonist molecules consisting of an IL-3 receptor agonist, of pMON13288 (WO 94/12638) joined via an IgG2b linker to either native flt3 ligand or sequence rearranged flt3 receptor agonists, Examples 91–93, were constructed. Inserts containing the desired sequence rearranged flt3 receptor agonists molecule were isolated from the parental plasmid as a NcoI/HindIII restriction fragment and ligated to pMON30311 digested with AflIII/Hind III/SAP Subsequent steps leading to final DNA sequence confirmation were done as described above. The resulting plasmids, containing the DNA sequences encoding multi-functional chimeric molecules comprising an IL-3 receptor agonist (from pMON13288) and a sequence rearranged flt3 receptor agonist are indicated in Table 10.

TABLE 10

| Resulting Plasmid | Flt3 ligand precursors |
| --- | --- |
| pMON32364 | pMON30237 |
| pMON32377 | pMON30238 |
| pMON32352 | pMON32321 |
| pMON32353 | pMON32320 |
| pMON32354 | pMON32325 |
| pMON32355 | pMON32324 |
| pMON32356 | pMON32323 |
| pMON32357 | pMON32328 |
| pMON32358 | pMON32327 |
| pMON32359 | pMON32326 |
| pMON32360 | pMON32348 |
| pMON32362 | pMON32350 |
| pMON32396 | pMON30239 |

EXAMPLE 98

Two chimeric molecules with the sequence rearranged hflt3 receptor agonist component at the N-terminus of the chimeric molecule were constructed via PCR using pMON32360 and pMON32362 plasmid DNA as the template and primer pairs N-term/134rev and N-term/139 rev to replace the stop codon at the C terminus of the native flt3 ligand molecules with an inframe SnaBI restriction site. Reaction mixtures were set up as described previously for pMON32322. Cycle conditions and were as follows: seven cycles of 94° C., one minute, 65° C., two minutes, and 72° C. 2½ minutes and an additional 10 amplification cycles were performed in which the annealing temperature was elevated from 65° C. to 70° C. Samples were purified using the Wizard PCR Purification kit and protocol, and eluted in 50 ul dH$_2$O, 20 ul of each sample was digested with NcoI and SnaBI. Plasmid, pMON26431, DNA was digested with NcoI and SnaBI and ligated with the NcoI/SnaBI digested PCR reactions. Transformation of competent DH5α cells and subsequent steps leading to final DNA sequence confirmation were done as described above.

EXAMPLE 99

Five additional hflt3 ligand breakpoints were made using the indicated primers 28/29(28For/28Rev), 34/35(34For/34Rev), 62/63 (62For/62Rev), 94/95 (94For/94Rev), and 98/99 (98For/98Rev) to amplify the ten and fifteen amino acid linker (GlyGlyGlySer)x as described above. The resulting PCR products were digested with NcoI/HindIII and ligated into pMON30311, digested with AflIII/HindIII/SAP as described previously. Transformation of competent DH5α cells and subsequent steps leading to final DNA sequence confirmation were done as described above.

EXAMPLE 100

For enhanced expression of sequence rearranged hflt3 receptor agonists in *E. coli*, N-terminal specific primers coding for degenerate codons were used to re-engineer both the 1–134 and 1–139 forms of native hflt3 ligand in the *E. coli* expression vector pMON5723. Primer pairs FH3AFor/SCF.rev (Ala2) and Flt23For/SCF (Gly2) were used to PCR amplify a N-terminal degenerate mixture of sequences encoding native flt3 ligand using reaction conditions as described for pMON23222, except that the number of amplification cycles was reduced to fifteen cycles of 1 minute at 95° C., 2 minutes at 55° C., and 2½ minutes at 72° C. Amplicons were purified using Wizard PCR Clean up kit (Promega), and eluted in 50 ul $dH_2O$. Restriction digestion with NcoI/HindIII and subsequent gel purification using Geneclean II was performed as previously described. Inserts were ligated to NcoI/HindIII/SAP-treated, gel-purified pMON5723 plasmid DNA, and transformed into competent DH5α cells as previously described. Aliquots of transformed cells were plated out on LB agarose media plates containing 75 ug/mL spectinomycin, incubated for 14–16 hours at 37° C., and colonies counted. After confirmation of colonies, the remainder of each transformation mixture was incubated overnight (14–16hr) at 37° C. in 2×5 mL of LB media containing 75 ug/mL spectinomycin. Miniprep DNA was prepared using a Wizard DNA 373A Miniprep kit (Promega) following the recommended protocol. Purified miniprep DNA was eluted in 50 ul $dH_2O$, and 1–2 ul used to transform chemically competent MON207 cells. 25 and 200 ul aliquots were plated out on LB media plates containing 75 ug/mL spectinomycin, and incubated for 12–15 hours at 37° C. 40–50 well-isolated colonies representing each original primer pair were selected and streaked out on LB/spectinomycin master plates, and incubated an additional 4–6 hours at 37° C.

Individual sequence rearranged hflt3 receptor agonist clones were screened for *E. coli* expression in a 96 well microtiter format to select for improved expression levels. Per well, 100 ul of minimal M9 media (including 1% casamino acids) was inoculated by a single colony (40–50 isolates were analyzed for each hflt3 PCR primer pair), and incubated at 37° C. at 200 rpm for 3–4 hr (I=0) and induced by addition of 5 ul/well of 1 mg/mL freshly prepared Nalidixic acid (in 0.1 N NaOH). After an additional four hours incubation at 37° C. (I=4), approximately 5–10 ul aliquots were withdrawn from each well, and analyzed by light microscopy for the presence of refractile bodies, and the results scored as a approximate percentage of cells containing refractile bodies to the total number of cells. The clones having the highest expression levels were selected for 10 mL benchtop scale expression studies as follows. Five mL overnight cultures were grown in LB media in the presence of 75ug/mL spectinomycin at 37° C. To 10 mL freshly prepared minimal M9 (with 1% casamino acids) in 125 mL shake flasks, inoculation with sufficient overnight cells to achieve an initial reading of 20 Klett units was done, and then incubated for ~3–4 hours at 37° C. with shaking until a density of ~110–150 Klett units was reached (I=0) and induced with 50 ul of freshly prepared Nalidixic acid (10 mg/mL in 0.1 N NaOH). One mL aliquots were removed and the cells pelleted for one minute in a microfuge. The supernatants were removed by aspiration and the pellets stored at −20° C. until ready for SDS-PAGE analysis. The remainder of the induced cells were incubated for an additional four hours at 37° C. with shaking, after this time point (I=4) cell density (in Klett units) was measured. A one mL aliquot was removed from each sample, pelleted and stored as described above. Another 5–10 ul aliquot was removed from each flask and analyzed by light microscopy for the presence of refractile bodies. Pelleted samples were resuspended in a volume (in ul) of 2× loading buffer (including 1% B-mercaptoethanol) equal to the I=4 Klett value, boiled for 5 minutes, and 6–7 ul loaded on a 12% or 14% Tris-Glycine SDS polyacrylamide gel (Novex) and electrophoresed for 90 minutes at 90 volts. Gels were fixed, stained and prepared for drying according the suggested protocol (Novex). Clones were selected at this point for scale up fermentation based upon enhanced expression levels of a single induced protein band (I=4) corresponding to the predicted size when compared to the I=0 samples.

Midiprep DNA was also prepared from selected clones expressing high level of induced protein as described previously and steps leading to final DNA sequence confirmation were done exactly as described above. These clones were designated pMON32329, pMON32330, pMON32341, and pMON32342

EXAMPLE 101

A set of multi-functional receptor agonist chimeric molecules comprising an IL-3 receptor agonist (from pMON13288) and native flt3 ligand were also constructed for expression in *E. coli*. The genes encoding the multi-functional receptor agonist chimeric molecules from pMON32364 and pMON32377 were released from the parental vector by digestion with NcoI/Hind III and ligated to pMON5677 vector, transformed into MON207 cells, and single isolates picked, as described above. These constructs were designated pMON32394 (insert from pMON32364) and pMON32395 (insert from pMON32377).

EXAMPLE 102

A truncated Flt3 receptor was isolated as a 1.4Kb PCR product using 50pmol of the primers FLTAFLS1 and FLTR1N with approximately 10 ng of the plasmid pMON27184 as the template. The primers were designed to produce an AflIII restriction site just 5' to the first Asn codon of the mature coding sequence, as well as an EcoRI restriction site just 5' to the putative transmembrane region. The reaction was digested with AflIII and EcoRI using standard reaction conditions and ligated into the NcoI/EcoRI digested plasmid pMON26458. This plasmid contains the following DNA sequence: 5'-GGATCCACCATGAGCCGCCTGCC-CGTCCTGCTCCTGCTCCAACTCCTGGTCCGCCCC-GCCATGGCTAAAGCTT-3' SEQ ID NO:857, encoding the IL-3 signal sequence. This sequence contains a BamHI restriction site on the 5' end, and includes the ATG methionine as the first amino acid of the signal sequence 3' to the BamHI site. This signal sequence is cleaved by the cell, leaving a 5' Met/Ala generated by fusing the NcoI site from the signal sequence fused to the AflIII site of the receptor produced in the PCR reaction. The entire truncated form of the receptor along with the IL-3 signal sequence could be cut back out of the vector as a BamHI/EcoRI digest (hIL3L/hFflt3R).

The catalytic domain of pMON30298 (hG-CSFR) was reengineered to create an in frame EcoRI restriction site at the transmembrane/cytoplasmic bound via PCR as follows. To 0.5 ug of heat denatured pMON30298, 100 pmole each of primers HGCFfor and HGCFrev, 10 ul of 5× buffer J,. 5 U of Taq polymerase, and $dH_2O$ were added to a final volume of 45 ul as described. PCR amplification was done as follows: six cycles (one minute at 94° C., two minutes at 64° C., and three minutes at 70° C.), followed by nine cycles (one minute at 94° C., four minutes at 70° C.). A final one minute extension of seven minutes at 70° C. was done. Ten ul of each PCR reaction were gel purified using Geneclean II as described previously, and eluted in 10 ul $dH_2O$. Samples were digested with 10 U each of EcoRI and HindIII in 20 ul reactions for 90 minutes at 37° C. Samples were gel purified again (Geneclean II) as described previously, and eluted in 10 ul $dH_2O$. Two ul of insert were ligated to 50 ng of NcoI/HindIII/phosphatased pSE420 vector in a 10 ul reaction as described previously. Transformation of competent DH5α cells and subsequent steps leading to final DNA sequence confirmation were done exactly as described above. Selected clones were then sequenced to verify the presence of the in frame EcoRI site as well as confirmation of the correct G-CSFR catalytic domain DNA sequence. Clones containing the predicted sequence were digested with EcoRI/HindIII as described previously and gel purified. Purified inserts of the hG-SCFR (EcoRI/HindIII) and hIL3L/hFlt3R (BamHI/EcoRI) fragments were ligated to BamHI/HindIII/phosphatased pcDNA 3.1 (−) vector (Invitrogen). Transformation of competent DH5α cells and subsequent steps leading to final DNA sequence confirmation were done as described above.

EXAMPLE 103

Additional genes encoding sequence rearranged Flt3 ligands were constructed using the dimer template intermediates previously described. For sequence rearranged flt3 receptor agonists having the fifteen amino acid linker $(GlyGlyGlySer)_3$GlyGlyGly SEQ ID NO:795, the dimer intermediates Flt4C.seq and Flt11N.seq were used as template. Breakpoints corresponding to Flt3 3 ligand amino acid residues 28/29, 34/35, 62/63, 94/95, and 98/99, were constructed using a PCR based approach using a PCR Optimizer kit (Invitrogen) and the following primer pairs; FL29For/FL29Rev, FL35For/FL35Rev, FL63For/FL63Rev, FL95For/FL95Rev, FL99For/FL99Rev as described IN Example 94. Amplification conditions were as follows: seven cycles of 94° C. for 1 min, 62° C. for 2 min, and 2.5 min at 70° C.; twelve cycles of 94° C. for 1 min, 68° C. for 2 min, and 70° C. for 2.5 min; followed by a final cycle of 7 min at 72° C. PCR products corresponding to the predicted insert size were digested with NcoI and HindIII, and gel purified as described previously using Gene Clean II (Bio 101) following the manufacturer's suggested protocol. Samples were resuspended in 10 ul final volume with $dH_2O$. Inserts were cloned as single genes into the mammalian expression vector pMON3934 (NcoI/HindIII/SAP treated) and designated pMON35712, pMON35713, pMON35714, pMON35715, pMON35716, pMON35717 and pMON35718 respectively.

Genes encoding chimeric proteins comprising an IL-3 receptor agonist encoded by pMON13288 (WO 94/12638) herein referred to as "IL-3 receptor agonist I", and sequence rearranged Flt3 ligand were prepared by cloning the purified, restriction-digested PCR products of the 28/29, 34/35, 62/63, 94/95, and 98/99 breakpoint primer pairs into AflIII/HindIII/SAP-treated pMON30311. The resulting plasmids were designated pMON32398, pMON35700, pMON35702, pMON35704, and pMON35706 respectively. In addition, the same primer pairs were used in conjunction with the dimer template intermediates Flt7N.seq and Flt3C.seq to construct the ten amino acid linker (GlyGlyGlySer)$_2$GlyGly SEQ ID NO:793, forms of these IL-3 receptor agonist I/Flt3L chimeric proteins; pMON32397, pMON32399, pMON35701, pMON35703, and pMON35705 respectively.

EXAMPLE 104

Genes encoding IL-3 receptor agonist I/Flt3L chimeric proteins containing the 21 amino acid residue linker (GlyGlyGlySer)$_5$Gly SEQ ID NO:796 were constructed using a similar PCR approach using the dimer template intermediates Flt11N.seq and Flt10C.seq and the following primer pairs; Flt36/36Rev, Flt37/37Rev, Flt38/38Rev, Flt39/39Rev, Flt41/41Rev, Flt42/42Rev, and Flt43/43Rev. These primer pairs correspond to the following Flt3 ligand breakpoints 35/36; 36/37; 37/38; 38/39; 40/41; 41/42; and 42/43 (the 39/40 breakpoint was previously constructed as pMON32376) and were used for PCR amplification using the following cycle conditions: seven cycles of 94° C. for 1 min, 66° C. for 2 min, and 2.5 min at 70° C.; fifteen cycles of 94° C. for 1 min, and 70° C. for 4 min; followed by a final cycle of 7 min at 72° C. using the Invitrogen PCR Optimizer kit (Buffer B). Following DNA sequence confirmation these constructs were designated pMON35733, pMON35734, pMON35735, pMON35736, pMON35738, pMON35739, pMON35740, pMON35741, pMON35742 and pMON35743 respectively. PCR incorporation errors resulted in two single amino acid substitutions of the sequence rearranged Flt3 chimeric partner (pMON35741, 35/36 breakpoint; and pMON35743, 42/43 breakpoint) and one construct (pMON35742, 38/39breakpoint) containing two amino acid substitutions $Q^{133}$ to $R^{133}$ and $Q^{100}$ to $R^{100}$ and $L^{112}$ to $P^{112}$ in the Flt3L moiety, constructed and tested as part of this serieS.

Additional Flt3L/IL-3 receptor agonist I chimeric proteins in which the alternate Flt3L breakpoints corresponding to Flt3 ligand amino acid residues 28/29, 34/35, 62/63, 65/66, 89/90, 94/95, and 98/99 previously described were also constructed with the fifteen amino acid linker (GlyGlyGlySer)$_3$GlyGlyGly templates FLt4C and FLt11N. PCR reaction mixtures were similar to those described in Example 103, except that reverse primers encoding the C-terminus of the sequence rearranged Flt3 moieties were modified by replacing the HindIII restriction site with a SnaBI recognition sequence. PCR amplification cycle parameters were as follows: seven cycles of 94° C. for 1 min, 66° C. for 2 min, and 2.5 min at 70° C.; fourteen cycles of 94° C. for 1 min, and 70° C. for 4 min; followed by a final cycle of 7 min at 72° C. PCR clean up, restriction digestion and purification were done as described previously. Inserts were ligated to NcoI/SnaBI/SAP-treated pMON26431 (a BHK expression vector containing an IgG2b linker/IL-3 receptor agonist I moiety) as follows: 50ng treated vector, insert (10:1 insert:vector), 1 unit of T4 DNA ligase (Gibco BRL), and 1 ul 10× ligase buffer in a 10 ul reaction volume. Ligations were incubated for one hour at ambient temperature, then 2 ul of each ligation were removed and used to transform 100 ul of chemically competent DH10B (alternatively, DH5α) cells (Gibco BRL) following the manufacturer's suggested protocol. One fifth and ½5th volumes of each transformation mixture were plated out on LB agar plates supplemented with the appropriate antibiotic markers and incubated overnight (14–16 hours) at 37° C. Isolated colonies were picked, and DNA prepared using the Qiagen midiprep protocol as described previously.

Sequence analysis of selected clones were confirmed for 28/29 breakpoint (pMON35719), 34/35 breakpoint (pMON35720), 62/63 breakpoint (pMON35721), 65/66 breakpoint (pMON35722), 89/90 breakpoint (pMON35723), and 98/99 breakpoint (pMON35725). pMON35726 contains a single amino acid substitution (Leu94 to Phe94) for the 94/95 breakpoin. Flt3L/IL-3 receptor agonist I chimeric constructs with a Flt3L breakpoint of 39/40 and varying amino acid linker lengths of 10, 15, and 21 AA are represented by pMON35707, pMON35708, pMON35709, pMON35710 and pMON35711. These constructs were generated by PCR amplification of one of the following templates; pMON32373, pMON32375, or pMON32376, and the Flt3L-specific primer pair 39N TERM-1/SNAB1C TERM. Standard PCR reaction mixtures were set up as previously described, and DNA product amplified using the following parameters: seven cycles of 94° C. for 1 min, 62° C. for 2 min, and 2.5 min at 70° C.; twelve cycles of 94° C. for 1 min, 68° C. for 2 min, and 70° C. for 2.5 min; followed by a final cycle of 7 min at 72° C. PCR products corresponding to the predicted insert size were digested to completion with NcoI and SnaBI, gel purified, and cloned as described previously into the mammalian expression vector pMON26431 (NcoI/SnaBI/SAP treated) as Flt3L/IgG2b/IL-3 receptor agonist I chimeric proteins. Two of these constructs contained PCR incorporation errors in the sequence rearranged Flt3 chimeric partner which resulted in single amino acid substitutions $F^{96}$ to $L^{96}$, and $E^{58}$ to $G^{58}$ (pMON35710 and pMON35711).

EXAMPLE 105

Another series of chimeric proteins, sequence rearranged Flt3L/IL-3 receptor agonist I with the breakpoints corresponding to Flt3 ligand amino acid residues 35/36, 36/37, 38/39, 40/41, 41/42, 42/43 and 65/66 previously described and a 21 amino acid linker were also constructed using selected IL-3 receptor agonist I/sequence rearranged Flt3L constructs as template (see Table 11 below). One exception was that a fifteen amino acid linker template (pMON35715) was used to construct the 65/66 breakpoint, pMON35771.

TABLE 11

| Flt3L/IL-3 receptor agonist I IL-3 receptor agonist I/Flt3L | | | |
|---|---|---|---|
| Construct | template | Flt3L breakpoint | Primer Pair |
| pMON35744 | pMON35733 | 35/36 | Flt36/36Rev' |
| pMON35745 | pMON35734 | 36/37 | Flt37/37Rev' |
| pMON35746 | pMON35735 | 37/38 | Flt38/38Rev' |
| pMON35747 | pMON35736 | 38/39 | Flt39/39Rev' |
| pMON35748 | pMON35738 | 40/41 | Flt41/41Rev' |
| pMON35749 | pMON35739 | 41/42 | Flt42/42Rev' |
| pMON35750 | pMON35740 | 42/43 | Flt43/43Rev' |
| pMON35769 | pMON35743 | 42/43 | Flt43/43Rev' |
| pMON35771 | pMON35715 | 65/66 | 65For/66SnaBI |

Primer pairs encoding the same restriction sites as those used to construct pMON35719–35725 were utilized. The reverse primers 36Rev', 37 Rev', 38 Rev', 39 Rev', 41 Rev', 42 Rev', and 43 Rev', were used to create the in frame SnaBI site. The same forward primers Flt36, Flt37, Flt38, Flt39, Flt41, Flt42 and Flt43 were used. PCR reaction mixtures were identical to those described previously, however, with the exception of pMON35771, amplification conditions were modified as follows: 18 cycles of 94° C. for 1 min, 68° C. for 2 min, and 70° C. for 2.5 min; followed by a single extension cycle at 70° C. for 7 minutes. For pMON35771, amplification conditions were as follows: six cycles of 94° C. for 1 min, 66° C. for 2 min, and 2.5 min at 70° C.; fifteen cycles of 94° C. for 1 min, and 70° C. for 4 min; followed by a final cycle of 7 min at 72° C. Flt3-specific PCR amplification products were restriction digested, purified, and cloned into pMON26431 (a BHK expression vector containing an IgG2b linker/IL-3 receptor agonist I moiety) as described in Example 104.

One variant, pMON32179, was constructed as a 34/40 breakpoint using the PCR primer pair Flt40/34Rev and dimer template intermediates Flt11N.seq and Flt10C.seq. PCR amplification conditions and subsequent cloning were identical to that used to clone pMON35771.

Three additional Flt3L/IL-3 receptor agonist I chimera (38/39 breakpoint) were designed and constructed to test the effects of alternate linker lengths and composition. Using pMON35709 as template, the GlySer linker length was expanded to encompass 29 amino acid residues with the motif $(GlyGlyGlySer)_7Gly$ using the primer pairs BamFor1/38Rev (reaction product referred to as PCR A) and Flt38/BamRev1 (reaction product referred to as PCR B). The amplification conditions were as follows: six cycles of 94° C. for 1 min, 66° C. for 2 min, and 2.5 min at 70° C.; fifteen cycles of 94° C. for 1 min, and 70° C. for 4 min; followed by a final cycle of 7 min at 72° C. The resulting PCR products were cleaned up using a Promega PCR clean up kit, and digested with either NcoI/BamHI (PCR A) or BamHI/SnaBI (PCR B), gel purified and ligated to pMON26431 (a BHK expression vector containing an IgG2b linker/IL-3 receptor agonist I moiety) as described previously. The resulting construct was sequenced confirmed and designated pMON35774. In comparison, pMON35775 and 35776 different in that the GlySer linker was replaced by native Flt3L amino acid residues 140–154 (pMON35775) or 140–160 (pMON35776) containing a single amino acid substitution. PCR reaction conditions were identical as described for pMON35774, except the following primer pairs were used: 38For/Navfor and 38Rev/NavRevS (pMON35775); and 38For/Navfor and 38Rev/NavRevL (pMON35776). KasI was substituted for BamHI, otherwise the cloning steps of these PCR amplification products were identical to those employed for pMON35774. Sequence analysis revealed PCR induced errors in multiple isolates for both pMON35775 and 35776. To obtain the final correct sequences, it was necessary to redigest selected subclones with NarI/SnaBI and NcoI/NarI, and use these gel purified fragments to reclone the desired constructs. Several Flt3L dimer chimeric molecules were also constructed for testing as BHK transients. pMON32173, consisting of two native Flt3L molecules linked by an IgG2b linker, was assembled from two pre-existing molecules as follows: the NcoI/SnaBI Flt3L-containing insert from pMON32393 was ligated to gel purified, NcoI/SnaBI cut, pMON32377 in which the IL-3 receptor agonist I chimeric partner had been released. Similarly, pMON35727 (39/40 breakpoint, fifteen amino acid linker) was assembled using the Flt3L insert from pMON35708 (as an NcoI/SnaBI insert) to gel purified pMON32375 in which the IL-3 receptor agonist I chimeric partner had been excised. The third Flt3L dimer, pMON32168, (39/40 breakpoint, 21 amino acid linker) was assembled as follows: the NcoI/SnaBI insert from pMON32165 (*E. coli* equivalent of pMON35709, assembled by subcloning the NcoI/BamHI fragment from pMON32163 and the BamHI/HindIII fragment of pMON35709 into NcoI/HindIII-digested pMON5723). The NcoI/SnaBI insert from pMON32165 (Flt3L 1–139 (39/40)L21) and the SnaBI/HindIII insert (IgG2b/Flt3L 1–139 (39/40)L21) from pMON32376 were subcloned into the *E. coli* production vector pMON5723, creating pMON32167. The NcoI/HindIII insert from pMON32167 was then subcloned into pMON30304, and designated pMON32168.

EXAMPLE 106

A series of trimeric molecules, each consisting of two Flt3L moieties and a single copy of IL-3 receptor agonist I or IL-3 receptor agonist II (an IL-3 receptor agonist encoded by pMON13416 (WO 94/12638) herein referred to as "IL-3 receptor agonist II"), were also constructed from pre-existing molecules using restriction digested, gel purified fragments. pMON35728 was assembled using the NcoI/EcoRI (Flt3L/IgG2b/IL-3 receptor agonist I) insert from pMON32375 and the EcoRI/HindIII (IL-3 receptor agonist I/IgG2b/Flt3L) insert from pMON35708. The two fragments were then religated to NcoI/HindIII/SAP-treated mammalian expression vector pMON3934 and subcloned as described previously. pMON32205 (IL-3 receptor agonist II/IgG2B/Flt3 1–139/IgG2B/Flt3 1–139) was assembled by ligating the NcoI/HindIII fragment from pMON32173 into the AflIII/HindIII site of pMON30304. A similar approach was used to construct pMON32206 (IL-3 receptor agonist II/IgG2b/Flt3L (39/40)L21/IgG2b/Flt3L (39/40)L21). The NcoI/HindIII fragment from pMON32167 was gel and subcloned into the AflIII/Hind III-digested pMON30304 (which contains the IL-3 receptor agonist II/IgG2b-moiety). The plasmid pMON32207 (Flt3L (39/40)L21/IgG2b/Flt3L (39/40)L21)/G-CSF) was assembled by subcloning the gel purified NcoI/HindIII insert from pMON32170 into the intermediate pMON32198 (AflIII/HindIII).

pMON32208 (Flt3L 1–139/IgG2b/G-CSF/IgG2b/Flt3L1–139) was assembled by subcloning the gel purified SnaBI insert from pMON30320 (as IgG2b/G-CSF) into SnaBI-digested/SAP-treated pMON32173. pMON32204 was assembled by subcloning the NcoI/HindIII insert from pMON32173 into AflIII/HindIII-digested pMON30309 (which contains G-CSF/IgG2b). pMON32195 (Flt3L 1–139 (39/40)L21/IgG2b/G-CSF/Flt3L 1–139(39/40)L21) was constructed by subcloning the NcoI/SacI insert from pMON32190 and the SacI/HindIII fragment from pMON32171 into NcoI/HindIII-digested pMON30304. pMON32196 (G-CSF/IgG2b/Flt3L 1–139(39/40)L21/IgG2b/Flt3L 1–139) was assembled by subcloning the NcoI/AflIII fragment from pMON30309 (as G-CSF/IgG2b) into NcoI/SAP-treated pMON32168 (Flt3L 1–139(39/40)L21/IgG2b/Flt3L 1–139), and confirming orientation by DNA sequence and restriction analysis. pMON32197 (G-CSF/IgG2b/Flt3L 1–139(39/40)L21/IgG2b/Flt3L 1–139 (39/40)L21) was constructed by subcloning the NcoI/HindIII insert of pMON32167 (Flt3L 1–139(39/40)L21/IgG2b/Flt3L 1–139 (39/40)L21) into the AflIII/HindIII site of pMON30309 (G-CSF/IgG2b).

EXAMPLE 108

A series of Flt3L containing molecules was constructed as BHK transients by replacing IL-3 receptor agonist I or IL-3 receptor agonist II with G-CSF as the chimeric partner. For chimeric proteins expressed transiently and made using the BHK vector pMON3934, the G-CSF moiety could either encode Ser or Cys at position 17. For molecules used for either *E. coli* expression or expressed non-transiently in mammalian expression systems, position 17 of the G-CSF partner encoded Ser exclusively. Chimera of native Flt3L and G-CSF were made as BHK expression constructs in both orientations: G-CSF/IgG2b/Flt3L (pMON30329) and Flt3L/IgG2b/G-CSF (pMON32175). pMON30329 was assembled by subcloning the Flt3L 1–139 insert from pMON30238 (as a NcoI/Hind III digest) into pMON30309 (which contains G-CSF/IgG2b) digested with AflIII/HindIII, whereas pMON32175 was constructed using the gel-purified NcoI/SnaBI insert from pMON32393 to NcoI/SnaBI-digested pMON26420 (which contains the IgG2b/G-CSF gene). A third native G-CSF/Flt3L chimeric molecule, pMON32191, differs from pMON32175 in that it has a GlySer linker in place of the IgG2b chimeric linker and was designed for *E.coli* expression. pMON32191 was assembled using the same gel-purified NcoI/SnaBI insert from pMON32393 into NcoI/SnaBI-digested pMON31123 (which contains the GlySer/G-CSF gene). The BHK equivalent, pMON35767, was assembled by subcloning the gel-purified NcoI/HindIII chimeric gene from pMON32191 into the BHK vector pMON3934.

EXAMPLE 109

Two series of sequence rearranged Flt3L chimera were constructed by replacing the IL-3 receptor agonist I component with G-CSF. The first set, with the orientation G-CSF/IgG2B/sequence rearranged Flt3L, were essentially assembled as follows: pMON30329 (G-CSF/IgG2B/Flt3L 1–139) was digested with SnaBI/HindIII, and the vector-containing G-CSF moiety gel-purified as described above. SnaBI/HindIII-digested inserts from the appropriate IL-3 receptor agonist I/Flt3L constructs shown below in Table !2were then subcloned into pMON30329 (SnaBI/HindIII).

TABLE 12

G-CSF/IgG2b/Flt3L constructs and their IL-3 receptor agonist I analogues

| Flt3L breakpoint | pMON (G-CSF) | pMON (IL-3 receptor agonist I) |
|---|---|---|
| 35/36L21 | pMON32188 | pMON35733 |
| 89/90L21 | pMON32273 | pMON32389 |
| 37/38L21 | pMON35795 | pMON35735 |
| 38/39L21 | pMON35796 | pMON35736 |
| 40/41L21 | pMON35797 | pMON35738 |
| 41/42L21 | pMON35798 | pMON35739 |
| 42/43L21 | pMON35799 | pMON35740 | pMON32169 (G-CSF/IgG2b/Flt3L 1–139 (39/40)L21) was assembled using the NcoI/BamHI insert from pMON32163 and the BamHI/HindIII insert from pMON32370 subcloned into the AflIII/HindIII-digested pMON30309. Three molecules in this series have no direct IL-3 receptor agonist I counterparts. The first, pMON39914, was assembled using the BHK expression vector pMON30309 (which contains G-CSF/IgG2b) digested with AflIII/HindIII, and the Flt3 1–139 (39/40)L29 insert from pMON32243 (as NcoI/HindIII). For pMON39915, the Flt3L 1–154 (39/40) gene from pMON32242 (as a NcoI/HindIII insert) was subcloned into the parental vector pMON30309. pMON39916 was assembled exactly as for pMON39915, except that the Flt3L 1–160 (39/40) insert from pMON32252 was utilized. pMONs 32242, 32243, and 32252 are *E. coli* expression constructs containing a nonchimeric, sequence rearranged Flt3L gene (as NcoI/HindIII). Finally, the insert from pMON35799 was subcloned into pMON5723 (as an NcoI/HindIII fragment) for expression in *E. coli*. This *E. coli* production plasmid was designated pMON39904.

EXAMPLE 110

Many of the second series of G-CSF chimera with the orientation Flt3L/IgG2b/G-CSF were also constructed from their IL-3 receptor agonist I analogues as indicated below in Table 13.

TABLE 13

Flt3L /IgG2b/G-CSF constructs and their IL-3 receptor agonist I analogues

| Flt3L breakpoint | pMON (G-CSF) | pMON (IL-3 receptor agonist I) |
|---|---|---|
| 39/40L10 | pMON35751 | pMON35707 |
| 39/40L15 | pMON35752 | pMON35708 |
| 39/40L21 | pMON35753 | pMON35709 |
| 89/90L15 | pMON35754 | pMON35723 |
| 35/36L21 | pMON35755 | pMON35744 |
| 36/37L21 | pMON35756 | pMON35745 |
| 37/38L21 | pMON35757 | pMON35746 |
| 34/35L15 | pMON35759 | pMON35720 |
| 65/66L15 | pMON35760 | pMON35722 |
| 98/99L15 | pMON35765 | pMON35725 |

These constructs were assembled using NcoI/SnaBI-digested pMON36113 (a BHK vector containing the IgG2b/G-CSF gene) and specific NcoI/SnaBI-digested sequence rearranged Flt3L inserts from the Flt3L/IL-3 receptor agonist I chimeric proteins in Table above. The resulting plasmids were designated pMON32170, pMON32871, pMON32271, pMON32172, pMON32174, pMON35751, pMON35752, pMON35753, pMON35754, pMON35755, pMON35756, pMON35757, pMON35758, pMON35759, pMON35760, pMON35761, pMON35762, pMON35763, pMON35764, pMON35765, pMON35766, pMON35767, pMON35768, pMON35770, pMON35772, pMON35773, pMON35777, pMON35778, pMON35779, pMON35780, pMON35782 and pMON39908 pMON35777 and pMON35778 were constructed by PCR and assembled from the same NcoI/NarI and NarI/SnaBI inserts as described for pMON35775 and pMON35776, except that NcoI/SnaBI-digested pMON35751 was used as the parental vector containing the IgG2b/G-CSF gene. To construct the 39/40 breakpoint equivalent of pMON35778, the primer pair Flt40/SnaBI C-term was used to re-amplify pMON35778 template. Amplification conditions were done as described previously for pMON35771, except the initial Ta$_{anneal}$ was lowered from 66 to 55° C. The resulting construct was designated pMON35782 (Flt3 1–160 (39/40)/IgG2b/G-CSF).

pMON32170 (Flt3L 1–139(39/40)L21/IgG2B/G-CSF) was assembled using the NcoI/SnaBI insert from pMON32165 ligated into NcoI/SnaBI-digested pMON26430 (which contains IgG2B/G-CSF). pMON35764 (Flt3L (38/39)L21/IgG2b/G-CSF) was cloned as follows: the sequence rearranged Flt3L insert was PCR amplified using as template pMON35736 and the primer pair Flt39/39Rev. Amplification conditions were identical to those employed for pMON35771, except the initial Tanneal was lowered from 66 to 56° C. The NcoI/SnaBI digested PCR amplification was subcloned into NcoI/SnaBI-digested pMON35754 containing the IgG2b/G-CSF gene. pMON35768 (Flt3L (38/39)L21/IgG2b/G-CSF) has a mutation at residue 15 (Ser to Phe) of the Flt3 chimeric partner. pMON35762 (Flt3 template pMON35739), pMON35763 (Flt3 template 35738), pMON35758 (Flt3 template 35740), pMON35770 (pMON35743 as Flt3L template were constructed exactly as described for pMON35764. pMON35772, a $S^{125}$ to $F^{125}$ mutant of the sequence rearranged Flt3 gene in pMON35760, was cloned by PCR using pMON35715 as Flt3 template and the primer pairs 65For/65SnaBI. PCR cycle conditions were identical to that used to amplify the Flt3 genes from pMON35733, pMON35734, pMON35735 and pMON35736 described previously. pMON35761 is a $Q^{133}$ to $R^{133}$ mutant of the sequence rearranged Flt3L gene in pMON35758. pMON35773 (Flt3L 1–139 (38/39)L29/IgG2B/G-CSF) was cloned as described previously for pMON35774, except pMON26430 (NcoI/

SnaBI/SAP-treated) containing the IgG2b/G-CSF gene was used as parental vector.

To construct the 39/40 breakpoint equivalent, pMON35773 was used as template in a PCR amplification reaction with the primer pair Flt40/SnaBI C-term. Amplification was done exactly as described previously for pMON35771. The NcoI/SnaBI-digested amplification product was subcloned into pMON26430 (NcoI/SnaBI/SAP-treated), resulting in pMON35779 (Flt3L 1–139 (39/40)L29/IgG2B/G-CSF). pMON35780 is a variant of pMON35779 and encodes a single amino acid mutation ($L^{60}$ to $P^{60}$) in the sequence rearranged Flt3 chimeric partner. pMON32190 (Flt3L 1–139 (39/40)L21/GS/G-CSF) contains an alternate GlySer chimeric linker which replaces the IgG2b linker of pMON32170. The NcoI/SnaBI fragment Flt3L gene from pMON32165 (Flt3L 1–139 (39/40)L21/IgG2b/IL-3 receptor agonist I in the *E. coli* expression vector pMON5723) was subcloned into NcoI/SnaBI-digested pMON31123. The BHK expression equivalent, pMON35766, was constructed by subcloning the entire Flt3L/GlySer/G-CSF chimeric insert as an NcoI/HindIII fragment into pMON3934. pMON39908 is similar to pMON35779, except the Flt3L amino acid residues 133–160 have been replaced by the amino acid sequence, VETVFHRVSQDGLDLLTS SEQ ID NO:798, which is homologous to an alternate splice variant of Flt3L (Genbank accession number HSU29874). pMON32190 was used as a PCR template with the following sets of primer pairs Flt40/XbaRev and SnaBICterm/XbaFor. Amplification conditions were done as described previously for pMON35771, except the initial $T_{anneal}$ was lowered from 66 to 64° C. Both gel-purified PCR amplification products were digested with either NcoI/XbaI (Flt40/XbaRev PCR product) or XbaI/SnaBI (SnaBICterm/XbaFor PCR product) and subcloned into pMON26430 (NcoI/SnaBI/SAP-treated). pMON32273 (Flt3L 1–139 (39/40)L21/IgG2b/G-CSF) was constructed by PCR of pMON35777 with the primer pairs FltConNco/Grev to re-amplify the 38/39 Flt3L moiety as 39/40. The purified amplicon was digested with NcoI/SnaBI, and subcloned into the NcoI/SnaBI-digested pMON32191, and designated pMON32259 (for *E. coli* production). For BHK expression, the NcoI/HindIII insert from pMON32259 was subcloned into pMON3934 (NcoI/HindIII).

EXAMPLE 103

Another series of chimeric proteins were constructed in which the Flt3L partner contained one or two Cys mutations (Table XIA and XIB). pMON35790 (Flt3L 1–139($C^4 \rightarrow S^4$, $C^{85} \rightarrow S^{85}$)/GS/G-CSF (Ser17)), was constructed by PCR using pMON32191 as template and the primer pairs ClFor/C3Rev and C3For/139Rev in two reactions. pMON35791 (Flt3L 1–139($C^{93} \rightarrow S^{93}$, $C^{132} \rightarrow S^{132}$)/GS/G-CSF (Ser17)), was also constructed by PCR using pMON32191 as template and the primer pairs C5For/C6Rev and C5Rev/N-term. Amplification conditions were done as described previously for pMON35771, except the initial $T_{anneal}$ was lowered from 66 to 64° C. A second round of PCR was done using the amplicons (10 ul each) from the first round, and the PCR products were then purified, digested with NcoI/SnaBI, and subcloned into NcoI/SnaBI -digested pMON32191. PCR amplification conditions for the second round were modified as follows: the initial $T_{anneal}$ was increased to 68° C., and the number of cycles increased from 6 to 15. No additional amplification was required. These constructs, pMON35787 ($C^4 \rightarrow S^4$, $C^{85} \rightarrow S^{85}$) and pMON35788 ($C^{93} \rightarrow S^{93}$, $C^{132} \rightarrow S^{132}$) were used for *E. coli* expression. The BHK expression equivalents, pMON35790 and 35791, were constructed by subcloning the correctly mutated Flt3L/GlySer/G-CSF chimeric inserts as NcoI/HindIII fragments into pMON3934. pMON35792 (Flt3L 1–132($C^{132} \rightarrow S^{132}$)/GlySer/G-CSF (Ser17)) was constructed by PCR using pMON32191 as template and the primer pair FLD1Rev/FltNTerm.

pMON39905 (Flt3L 1–139($C^{132} \rightarrow S^{132}$)/GlySer/G-CSF (Ser17)) was constructed by PCR using pMON32191 as template and the primer pair FLM1Rev/FltNTerm. pMON39906 (Flt3L 1–139($C^{127} \rightarrow S^{127}$, $C^{32} \rightarrow S^{132}$)/GlySer/G-CSF (Ser17)) contains a single amino acid substitution at residue 127 of the sequence rearranged Flt3L partner, a result of a PCR induced error during the PCR amplification of pMON39905. pMON32276 (Flt3L 1–139 (39/40)L21 ($C^4 \rightarrow S^4/C^{85} \rightarrow S^{85}$)/GlySer/G-CSF (Ser17)) was constructed by two rounds of PCR. Three initial amplicons were generated: PCR1 (pMON32190 template and primer pairs GlOL/85N); PCR 7 (pMON32190 template and primer pairs 4N/85S); and PCR 4 (pMON32198 template and primer pairs 4S/3605Rev). For the second round, PCR1, 4 and 7 were re-amplified in a combined mixture, resulting in PCR A. PCR A was purified, digested with NcoI/SnaBI, and subcloned in pMON30277 (GlySer/G-CSF). The next three constructs were generated in a similar manner. pMON32277 (G-CSF (Ser17)/IgG2B/Flt3L 1–139 (39/40)L21($C^4 \rightarrow S^4/C^{85} \rightarrow S^{85}$)) first round PCR generated three initial amplicons: PCR1 (pMON32190 template and primer pairs G10L/85N); PCR 7 (pMON32190 template and primer pairs 4N/85S); and PCR 6 (pMON32169 template and primer pairs 4S/3605Rev). For the second round, PCR1, 6 and 7 were re-amplified in a combined mixture, resulting in PCR B. PCR B was purified, digested with NcoI/HindIII, and subcloned into NcoI/HindIII-digested pMON30309 (G-CSF (Ser17)/IgG2B). pMON32278 (Flt3L 1–139 (39/40)L21 ($C^{93} \rightarrow S^{93}/C^{132} \rightarrow S^{132}$)/GlySer/G-CSF (Ser17)) first round PCR generated three initial amplicons: PCR2 (pMON32190 template and primer pairs G10L/93N); PCR 8 (pMON32190 template and primer pairs 132N/93S); and PCR 3 (pMON32198 template and primer pairs 132S/3605Rev). For the second round, PCR2, 3 and 8 were re-amplified in a combined mixture, resulting in PCR C. PCR C was purified, digested with NcoI/SnaBI, and subcloned in pMON30277 (GlySer/G-CSF). pMON32279 G-CSF (Ser17)/IgG2B/Flt3L 1–139 (39/40)L21($C^{93} \rightarrow S^{93}/C^{132} \rightarrow S^{132}$)) first round PCR generated three initial amplicons: PCR2 (pMON32190 template and primer pairs G10L/93N); PCR 8 (pMON32190 template and primer pairs 132N/93S); and PCR 5 (pMON32169 template and primer pairs 132S/3605Rev). For the second round, PCR2, 5 and 8 were re-amplified in a combined mixture, resulting in PCR D. PCR D was purified, digested with NcoI/HindIII, and subcloned into NcoI/HindIII-digested pMON30309 (G-CSF(Ser17)/IgG2B).

EXAMPLE 112 pMON39909 (Flt3L 1–139(39/40)L21/GS/G-CSF(Ser17) (133/132)) is one of two Flt3/G-CSF chimeric proteins in which both proteins the sequenced are rearranged. The NcoI/AflIII fragment from pMON32198 comprising the Flt3L 1–139(39/40)L21/GlySer gene was subcloned into NcoI/SAP-treated pMON25187 (*E. coli* production plasmid containing a single copy of G-CSF(Ser17) (133/132)). Following DNA sequence confirmation, the chimeric insert was subcloned into pMON3934 as an NcoI/HindIII fragment and designated pMON39909. pMON39910 (G-CSF(Ser17) (133/132/IgG2B/Flt3L 1–139(39/40)L21) was constructed by PCR using pMON25187 as template and the primer pair GPFor1/GPRev2. Amplification conditions were identical to those utilized for pMON39908. NcoI/SnaBI-digested G-CSF(Ser17) (133/132) was subcloned into the NcoI/SnaBI site of pMON32376 containing the IgG2B/Flt3L 1–139 (39/40)L21 gene.

EXAMPLE 113 pMON40000 is the production plasmid modified from pClneo (Promega) containing G-CSF(Ser17)/GlySer/Flt3L 1–139 (39/40)L21 for expression in NS0 cells (pMON32169 is the BHK equivalent). pMON40000 contains the CMV IE promoter/enhancer element, an IL-3 leader sequence immediately upstream of CSF(Ser17)/GlySer/Flt3L 1–139 (39/40)L21, truncated thymidine kinase promoter, SV40 late poly A signal sequence, and several DNAse 1 hypersensitive regions (part of IgH 3 min LCR).

EXAMPLE 114

Bioactivity of Multi-Functional Chimeric Hematooeietic Receptor Agonists

TABLE 14

IN VITRO MULTI-FUNCTIONAL CHIMERIC HEMATOPOIETIC RECEPTOR AGONISTS BIOASSAY

| Clone | BAF3/FLT3L Proliferation[1] | BAF3/FLT3L *Proliferation[2] | CFU-GM Colonies[3] |
|---|---|---|---|
| pMON30247 | ++ | + | + |
| pMON32169 |  | +++ | +++ |
| pMON32175 |  | +++ |  |
| pMON32190 |  | +++ |  |
| pMON32191 |  | +++ | +++ |
| pMON32333 | + |  |  |
| pMON32342 | ++ |  |  |
| pMON32352 | + |  | + |
| pMON32360 | + |  | + |
| pMON35766 | + |  |  |
| pMON40000 |  |  | +++ |
| pMON40002[4] |  | ++ | +++ |

Legend:
+: Decreased potency (right shifted) compared to control
++: Equivalent potency to control (within 2 fold)
+++: Increased potency (left shifted) compared to control
[1]Compared to control: pMON30247
[2]Compared to control: pMON32352
[3]Compared to appropriate coaddition control
[4]Analyzed in pool of clones pMON40000 and pMON40002

EXAMPLE 115

Bioactivity Determination

TABLE 15

EX VIVO MULTI-FUNCTIONAL CHIMERIC HEMATOPOIETIC RECEPTOR AGONISTS BIOASSAY

| Clone(s) | Hematopoietic Ex Vivo Expansion[1] | | | Dendritic Cell Ex Vivo Expansion[2] | |
|---|---|---|---|---|---|
|  | Fold Expansion | Neutrophil Precursors | Megakaryocyte Precursors | Fold Expansion | Function |
| pMON32175 | + | + | + |  |  |
| pMON32191 | + | + | ++ | ++ | ++ |
| pMON32360 | + | + | + | ++ |  |
| Il-3 receptor agonist I, MFR agonist I, MFR agonist II | ++ | ++ | ++ |  |  |
| Il-3 receptor agonist I, MFR agonist I, MFR agonist II, pMON30247 | +++ | ++ | +++ |  |  |
| Il-3 receptor agonist I, MFR agonist I, MFR agonist II, pMON32360 | +++ | ++ | ++ |  |  |
| Il-3 receptor agonist I, MFR agonist I, MFR agonist II, pMON32333 | ++ | ++ | ++ |  |  |
| Il-3 receptor agonist I, MFR agonist I, MFR agonist II, pMON32191 | +++ | +++ | +++ |  |  |
| Il-3 receptor agonist I, MFR agonist I, MFR agonist II, pMON32175 | ++ | +++ | +++ |  |  |
| MFR agonist II, pMON32191 | + | + | +++ |  |  |
| pMON30247 |  |  |  | +++ | ++ |
| pMON32352 |  |  |  | ++ |  |

[1]Legend:
+: Decreased activity compared to IL-3, IL-6, SCF,G-CSF (literature control)
++: Equivalent activity to IL-3, IL-6, SCF,G-CSF ((literature control) (within 20%))
+++: Increased activity compared to IL-3, IL-6, SCF,G-CSF (literature control)
Culture Condition: X-Vivo 10 Media, 37° C., 5% $CO_2$, 11 day incubation
[2]Legend:
+: Decreased activity compared to GM-CSF, TNFa, SCF (literature control)
++: Equivalent activity to GM-CSF, TNFa, SCF ((literature control) (within 20%))
+++: Increased activity compared to GM-CSF, TNFa, SCF (literature control)
Culture Condition: IMDM-20 Media supplemented with 100 ng/ml GM-CSF, 100 ng/ml TNFa, 20 ng/ml SCF, at 37° C./5% $CO_2$ for 18–22 days
MFR agonist I = pMON31140 (WO 95/21197)
MFR agonist II = pMON28571 (WO 97/12985)

Hematopoietic Ex Vivo Expansion Assay $CD34^{30}$ enriched progenitor cells from human bone marrow were isolated and cultured at $5 \times 10^4$ cells/ml in X-Vivo 10+1% HSA with test cytokines and controls to assess cytokine expansion potential. Cells were expanded and replated at $5 \times 10^4$ cells/ml with new media and cytokines around day 5 depending on cell growth. On day 10 cells were harvested and characterized. Cells were collected from the plates and diluted to a concentration of $1 \times 10^6$ cells/ml. Total cell expansion was determined and cells were characterized for hematopoietic progenitor cells by CFU Pre- and Post Expansion in methylcellulose (Stem Cell Technologies, MethocultHCC3534). Expanded cells were also characterized by flow cytometry for lineage specific phenotyping: CD11b(PE)/CD15(FITC), CD34 (FITC), CD41a (FITC).

Dendritic Cell Ex Vivo Expansion Assay $CD34^+$ enriched progenitor cells from human bone marrow were isolated and cultured at $2 \times 10^5$ cells/ml in IMDM/20% FCS with test cytokines and controls to assess expansion potential. Cells were expanded and replated at $5 \times 10^4$ cells/ml with new media and cytokines around day 5 depending on cell growth. On day 18–22 cells were harvested and characterized. Total cell expansion was determined expanded cells were characterized by flow cytometry for lineage specific phenotyping: HLA-DR+(PE)/CD1a+ (FITC), CD86+(PE)/CD1a+(FITC), CD19-(FITC). Dendritic cell fold expansion was determined as the total cellular expansion x % HLA-DR+/CD1a+. The functional activity of the cells was determined using a 1-way mixed lymphocyte reaction. Washed, irradiated cultured dendritic cells were added in graded doses to allogeneic responder peripheral blood mononuclear cells in 96-well microtiter plates. The ability of the dendritic cells to serve as antigen presenting cells was determined by the degree of proliferation stimulated in the responding cell preparations, as measured by $^3$H thymidine incorporation.

EXAMPLE 116

Receptor Binding

TABLE 16

Receptor Binding Analyses:

| Compound | Flt3-Fc $K_d$ (nM) | G-CSFR $IC_{50}$ (nM) | IL-3R" $IC_{50}$ (nM) |
|---|---|---|---|
| pMON32342 | 26 " 7 | — | >1000 |
| pMON30247 | 36 " 7 | — | 6.6 " 0.5 |
| pMON32360 | 45 " 17 | — | 26 (2) |
| pMON32352 | 56 " 5 | — | 13 " 4 |
| pMON32191 | 37 " 14 | 0.33 " 0.01 | — |
| Il-3 receptor agonist II | — | >1000 | 1.3 " 0.2 |
| Il-3 receptor agonist I | — | >1000 | 3.7 " 0.6 |
| G-CSF | — | 0.69 " 0.08 | >100 |

Data are expressed as the mean " SEM from at least three experiments determined in triplicate, except pMON 32360 where only (2) experiments have been completed.

The affinity of the Flt-3 agonist containing chimeric molecules was evaluated in receptor binding assays. BIA-CORE analysis was performed by directly immobilizing Flt3-Fc and the $K_d$ value computed from determining the association and dissociation rate constants. Competitive binding assays were utilized for evaluating the interactions of the chimeric molecules with either the G-CSF receptor transfected in BaF3 cells or the " subunit of the IL-3 receptor expressed in BHK cells. The competition assays using these cells employed an agonist-specific radioligand and $IC_{50}$ values were generated for the competing chimeras using logit-log analysis of dose-response curves.

EXAMPLE 117

In Vivo Bioactivity

TABLE 17

MURINE IN VIVO MULTI-FUNCTIONAL CHIMERIC HEMATOPOIETIC RECEPTOR AGONISTS ASSAY DATA

| | Peripheral Blood | | Spleen | | |
|---|---|---|---|---|---|
| Clone | I-A$^{b+}$/ CD11c* DC cells/ul blood | I-A$^{b+}$/ CD8* | I-A$^{b+}$/ CD11c* DC cells/Spleen (×10$^6$) | I-A$^{b+}$/ CD8* | CFU-GM/Spleen Fold Increase |
| pMON30247 | ND | ND | 33.5 | 23.8 | 78 |
| pMON32342 | ND | ND | 8.0 | 4.5 | 2 |

TABLE 17-continued

MURINE IN VIVO MULTI-FUNCTIONAL CHIMERIC HEMATOPOIETIC RECEPTOR AGONISTS ASSAY DATA

| | Peripheral Blood | | Spleen | | |
|---|---|---|---|---|---|
| Clone | I-A$^{b+}$/ CD11c* DC cells/ul blood | I-A$^{b+}$/ CD8* | I-A$^{b+}$/ CD11c* DC cells/Spleen (×10$^6$) | I-A$^{b+}$/ CD8* | CFU-GM/Spleen Fold Increase |
| pMON32360 | ND | ND | 64.5 | 37.5 | 183 |
| pMON32191 | 17,089 | 2,379 | 133.5 | 78.9 | 53 |

C57BL/6 mice were injected s.c. with pMON30247, pMON32342 or pMON32360 (150 ug/day) or pMON32191 (200 ug/day) or Mouse Serum Albumin (MSA, 200 ug/day) for 10 days. On Day 11 terminal bleeds were done via cardiac puncture. Leucocytes counts were obtained on whole blood. Peripheral blood leucocytes were obtained by gradient centrifugation (Histopaque) followed by ammonium chloride lysis to further remove erythrocytes. Cells were stained for flow cytometery using direct fluorescein or phycoerythrin conjugated monoclonal antibodies (Pharmingen). Prior to staining non-specific Fc receptor binding was blocked using FcBlock (Pharmingen). Cells were analyzed on a FacScan flow cytometer (Becton/Dickinson). Percent postive cells were determined by integration and phenotype enumeration was calculated based on WBC count. Spleens from treated animals were removed aseptically, teased apart, in RPMI media with needles. A cell suspension was obtained using the flat end of a 5 cc syringe plunger followed by filtration through a cotton plug to remove clumps. Erythrocytes were removed by ammonium chloride lysis, cells were washed, resuspended and counted using a Coulter counter (Coulter Electronics). Cells were prepared for flow cytometry as described above. Phenotype was expressed as number of cells/spleen based on the percent of cells with a postive phenotype and total spleen WBC count. CFU cultures were obtained by plating 1.5×10$^5$ splenic cells/lml in triplicate wells of methylcellulose with murine cytokines w/o erythropoietin (Stem Cell Technologies). Cultures were incubated for 10 days at 37° C. and counted on an inverted microscope. A CFU was defined as a colony of cells with >50 cells. The fold increase of CFU/spleen was determined (total number of CFU/Spleen of test compound/total number of CFU/Spleen of MSA control). MSA control values for peripheral blood were 15 and 347 cells/ul for I-A$^{b+}$/CD11 c$^+$ and I-A$^{b+}$/CD8$^+$ respectively. MSA control values for the splenic leucocytes were 2 and 1×10$^6$ cells/spleen for I-A$^{b+}$/CD11c$^+$ and I-A$^{b+}$/CD8$^+$ respectively.

Without further elaboration, it is believed that one skilled in the art can, using the preceding description, utilize the present invention to its fullest extent. The following preferred specific embodiments are, therefore, to be construed as merely illustrative, and not limitative of the remainder of the disclosure in any way whatsoever.

More details concerning the molecular biology techniques, protein purification and bioassays can be found in WO 94/12639, WO 94/12638, WO 95/20976, WO 95/21197, WO 95/20977, WO 95/21254 and WO 96/23888, are hereby incorporated by reference in their entirety.

All references, patents or applications cited herein are incorporated by reference in their entirety as if written herein.

Various other examples will be apparent to the person skilled in the art after reading the present disclosure without departing from the spirit and scope of the invention. It is intended that all such other examples be included within the scope of the appended claims.

SEQUENCE LISTING (865 sequences)

SEQ ID NO: 1 - DNA, 439 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgt

SEQ ID NO: 2 - DNA, 465 bp; single-stranded, linear
tccccagctccacctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattc

SEQ ID NO: 3 - DNA, 927 bp; single-stranded, linear
tccccagctccacctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagggcaggaccacagctcacaaggatcccaatgccatcttcctgagcttccaacacctgctccgaggaaaggtgcgtttcctgatgcttgtaggagggtccaccctctgcgtcagg

SEQ ID NO: 4 - DNA, 936 bp; single-stranded, linear
tccccagctccacctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagg

SEQ ID NO: 5 - DNA, 939 bp; single-stranded, linear
tccccagctccacctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagg

SEQ ID NO: 6 - DNA, 948 bp; single-stranded, linear
tccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagg

SEQ ID NO: 7 - DNA, 688 bp; single-stranded, linear
catggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagggtggtggctctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtac

SEQ ID NO: 8 - DNA, 712 bp; single-stranded, linear
catggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagggtggtggctctggcggtggcagcggcggcggttctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtac

SEQ ID NO: 9 - DNA, 975 bp; single-stranded, linear
atggctctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagggtggtggctctaactgctctataatgatcgatgaaattatacatcacttaaagagaccacctgcacctttgtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 10 - DNA, 975 bp; single-stranded, linear
atggctaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagggtggtggctctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaatacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 11 - DNA, 975 bp; single-stranded, linear
atggctgcaccctctcgacatccaatcatcatcaaggcaggtgactggcaagaattccgggaaaaactgacgttctatctggttacccttgagcaagcgcaggaacaacagggtggtggctctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggcctacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 12 - DNA, 975 bp; single-stranded, linear
atggctgcaggtgactggcaagaattccgggaaaaactgacgttctatctggttacccttgagcaagcgcaggaacaacagggtggtggctctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 13 - DNA, 999 bp; single-stranded, linear
atggctctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagggtggtggctctggcggtggcagcggcggcggttctaactgctctataatgatcgatgaaattatacatcacttaaagagaccacctgcacctttgtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 14 - DNA, 999 bp; single-stranded, linear
atggctaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagggtggtggctctggcggtggcagcggcggcggttctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaatacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 15 - DNA, 999 bp; single-stranded, linear
atggctgcaccctctcgacatccaatcatcatcaaggcaggtgactggcaagaattccgggaaaaactgacgttctatctggttacccttgagcaagcgcaggaacaacagggtggtggctctggcggtggcagcggcggcggttctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggcctacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 16 - DNA, 999 bp; single-stranded, linear
atggctgcaggtgactggcaagaattccgggaaaaactgacgttctatctggttacccttgagcaagcgcaggaacaacagggtggtggctctggcggtggcagcggcggcggttctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 17 - DNA, 918 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggcttacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctaataa

SEQ ID NO: 18 - DNA, 963 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcttacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctaataa

SEQ ID NO: 19 - DNA, 918 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggctcccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcctaataa

SEQ ID NO: 20 - DNA, 963 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcctaataa

SEQ ID NO: 21 - DNA, 918 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggctatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggataataa

SEQ ID NO: 22 - DNA, 963 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggataataa

SEQ ID NO: 23 - DNA, 918 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 24 - DNA, 963 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 25 - DNA, 918 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggcttctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctaataa

SEQ ID NO: 26 - DNA, 963 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcttctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctaataa

SEQ ID NO: 27 - DNA, 927 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggcttacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctaataa

SEQ ID NO: 28 - DNA, 972 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcttacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctaataa

SEQ ID NO: 29 - DNA, 927 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggctcccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcctaataa

SEQ ID NO: 30 - DNA, 972 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcctaataa

SEQ ID NO: 31 - DNA, 927 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggctatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggataataa

SEQ ID NO: 32 - DNA, 972 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggataataa

SEQ ID NO: 33 - DNA, 927 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggctacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 34 - DNA, 972 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 35 - DNA, 927 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatggcttctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctaataa

SEQ ID NO: 36 - DNA, 972 bp; single-stranded, linear
atggctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcttctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctaataa

SEQ ID NO: 37 - DNA, 963 bp; single-stranded, linear
atggctaactgctctaacatgatcgatgaaatcatcacccacctgaagcagccaccgctgccgctgctggacttcaacaacctcaatggtgaagaccaagatatcctaatggacaataaccttcgtcgtccaaacctcgaggcattcaaccgtgctgtcaagtctctgcagaatgcatcagcaattgagagcattcttaaaaatctcctgccatgtctgccgctagccacggccgcacccacgcgacatccaatccatatcaaggacggtgactggaatgaattccgtcgtaaactgaccttctatctgaaaaccttggagaacgcgcaggctcaacagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 38 - DNA, 972 bp; single-stranded, linear
atggctaactgctctaacatgatcgatgaaatcatcacccacctgaagcagccaccgctgccgctgctggacttcaacaacctcaatggtgaagaccaagatatcctgatggaaaataaccttcgtcgtccaaacctcgaggcattcaaccgtgctgtcaagtctctgcagaatgcatcagcaattgagagcattcttaaaaatctcctgccatgtctgcccctggccacggccgcacccacgcgacatccaatcatcatccgtgacggtgactggaatgaattccgtcgtaaactgaccttctatctgaaaaccttggagaacgcgcaggctcaacagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 39 - DNA, 963 bp; single-stranded, linear
atggctaactgctctaacatgatcgatgaaatcatcacccacctgaagcagccaccgctgccgctgctggacttcaacaacctcaatggtgaagaccaagatatcctgatggaaaataaccttcgtcgtccaaacctcgaggcattcaaccgtgctgtcaagtctctgcagaatgcatcagcaattgagagcattcttaaaaatctcctgccatgtctgcccctggccacggccgcacccacgcgacatccaatcatcatccgtgacggtgactggaatgaattccgtcgtaaactgaccttctatctgaaaaccttggagaacgcgcaggctcaacagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 40 - DNA, 970 bp; single-stranded, linear
atggctaactgctctaacatgatcgatgaaatcatcacccacctgaagcagccaccgctgccgctgctggacttcaacaacctcaatggtgaagaccaagatatcctaatggacaataaccttcgtcgtccaaacctcgaggcattcaaccgtgctgtcaagtctctgcagaatgcatcagcaattgagagcattcttaaaaatctcctgccatgtctgccgctagccacggccgcacccgcgacatccaatccatatcaaggacggtgactggaatgaattccgtcgtaaactgaccttctatctgaaaaccttggagaacgcgcaggctcaacagtacgtagagggcggtggaggctccccgggtgaaccgtctggtccaatctctactatcaacccgtctcctccgtctaaagaatctcataaatctccaaacatggctacccagggtgccatgccggccttcgcctctgctttccagcgccgggcaggaggggtcctggttgctagccatctgcagagcttcctggaggtgtcgtaccgcgttctacgccaccttgcgcagcccacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 41 - DNA, 918 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgccca

SEQ ID NO: 42 - DNA, 918 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccct

SEQ ID NO: 43 - DNA, 918 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacct

SEQ ID NO: 44 - DNA, 918 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcct

SEQ ID NO: 45 - DNA, 918 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtg

SEQ ID NO: 46 - DNA, 907 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatcggttacccttgagcaagcgcaggaacaacagtacgtagagggcggtggaggctccccggggaaccgtctggtccaatctctactatcaacccgtctcctccgtctaaagaatctcataaactccaaacatgggagaatggaaaacccagatggaggagaccaaggcacaggacattctggagcagtgacccttctgctggagggagtgatggcagcacggggacaactgggacccacttgctctcatccctcctggggcagctttctggacaggtccgtctcctccttggggccctgcaggcctccttggaacccagcttcctccacagggcaggaccacagctcacaaggatcccaatgcatcttcctgagcttccaacacctgctccgaggaaaggtgcgtttcctgatgcttgtagggggtccaccctctgcgtcagggaattcggcggcaacatggcgtctcccgctccgcctgctgtgacctccgagtcctcagtaaactgcttcgtgactcccatgtccttcacagcagactgaccagtgcccagaggttcaccctttgcctacacctgtcctgctgcctgctgtggactttagttg

SEQ ID NO: 47 - DNA, 917 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaact

SEQ ID NO: 48 - DNA, 918 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctcctt

SEQ ID NO: 49 - DNA, 918 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggcaggaccacagctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacag

SEQ ID NO: 50 - DNA, 918 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcacaaggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccaca

SEQ ID NO: 51 - DNA, 918 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaag

SEQ ID NO: 52 - DNA, 918 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaat

SEQ ID NO: 53 - DNA, 915 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgccca

SEQ ID NO: 54 - DNA, 915 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccct

SEQ ID NO: 55 - DNA, 915 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacct

SEQ ID NO: 56 - DNA, 915 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcct

SEQ ID NO: 57 - DNA, 915 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtg

SEQ ID NO: 58 - DNA, 915 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttg

SEQ ID NO: 59 - DNA, 915 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactg

SEQ ID NO: 60 - DNA, 915 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctcctt

SEQ ID NO: 61 - DNA, 915 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggcaggaccacagctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacag

SEQ ID NO: 62 - DNA, 915 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcacaaggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccaca

SEQ ID NO: 63 - DNA, 915 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggatcccaatgccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaag

SEQ ID NO: 64 - DNA, 915 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccatcttcctgagcttccaacacctgctccgaggaaaggtgcgtttcctgatgcttgtaggagggtccaccctctgcgtcagggaattcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaat

SEQ ID NO: 65 - DNA, 921 bp; single-stranded, linear
gctaactgctctataatgatcgatgaaattatacatcacttaaagagaccacctgcacctttgctggacccgaacaacctcaatgacgaagacgtctctatcctgatggaccgaaaccttgacttccaaacctggagagcttcgtaagggctgtcaagaacttagaaaatgcatcaggtatgaggcaattcttcgtaatctccaaccatgtctgccctctgccacggccgcaccctctcgcatccaatcatcatcaaggcaggtgactggcaagaattccgggaaaaactgacgttctattggttacccttgagcaagcgcaggaacaacagtacgtagagggcggtggaggctccccggtaaccgtctggtccaatctctactatcaacccgtctcctccgtctaaagaatctcataaatctccaaacatggaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgccca

SEQ ID NO: 66 - DNA, 927 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccct

SEQ ID NO: 67 - DNA, 927 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacct

SEQ ID NO: 68 - DNA, 927 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcct

SEQ ID NO: 69 - DNA, 927 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtg

SEQ ID NO: 70 - DNA, 927 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttg

SEQ ID NO: 71 - DNA, 927 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactg

SEQ ID NO: 72 - DNA, 927 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggaacccagcttcctccacagggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctcctt

SEQ ID NO: 73 - DNA, 927 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgggcaggaccacagctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacag

SEQ ID NO: 74 - DNA, 927 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcacaaggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccaca

SEQ ID NO: 75 - DNA, 927 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggatcccaatgccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaag

SEQ ID NO: 76 - DNA, 927 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccatcttcctgagcttccaacacctgctccgaggaaaggtgcgtttcctgatgcttgtaggagggtccaccctctgcgtcagggaattcggcggcaacggcggcaacatggcgtccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaat

SEQ ID NO: 77 - DNA, 906 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggatcccaatgccatcttcctgagcttccaacacctgctccgaggaaaggtgcgtttcctgatgcttgtaggagggtccaccctctgcgtcagggaattcggcggcaacatggcgtctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagggcaggaccacagctcacaag

SEQ ID NO: 78 - DNA, 993 bp; single-stranded, linear
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgtcttacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccggcggcggctctgacatggctacaccattaggccctgccagctccctgccccagagcttcctgctcaagtctttagagcaagtgaggaagatccagggcgatggcgcagcgctccaggagaagctgtgtgccacctaataa

SEQ ID NO: 79 - DNA, 993 bp; single-stranded, linear
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgtctcccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccggcggcggctctgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcctaataa

SEQ ID NO: 80 - DNA, 993 bp; single-stranded, linear
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgtcttctgctttccagcgccgggcaggaggggtcctggttgctagccatctgcagagcttcctggaggtgtcgtaccgcgttctacgccaccttgcgcagcccggcggcggctctgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctaataa

SEQ ID NO: 81 - DNA, 993 bp; single-stranded, linear
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgtctatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccggcggcggctctgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggataataa

SEQ ID NO: 82 - DNA, 993 bp; single-stranded, linear
atggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgtctacccagggtgccatgccggccttcgcctctgctttccagcgccgggcaggaggggtcctggttgctagccatctgcagagcttcctggaggtgtcgtaccgcgttctacgccaccttgcgcagcccggcggcggctctgacatggctacaccattaggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctaataa

SEQ ID NO: 83 - DNA, 1027 bp; single-stranded, linear
atggctacaccattgggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcccggcggcggctctgacatggctacaccattgggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccatcctggttgctagccatctgcagagcttcctggaggtgtcgtaccgcgttctacgccaccttgcgcagccctgataa

SEQ ID NO: 84 - DNA, 459 bp; single-stranded, linear
tctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagg

SEQ ID NO: 85 - DNA, 447 bp; single-stranded, linear
tctcccgctccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagggcaggaccacagctcacaaggatcccaatgccatcttcctgagcttccaacacctgctccgaggaaaggtgcgtttcctgatgcttgtaggagggtccaccctctgcgtcagg

SEQ ID NO: 86 - DNA, 459 bp; single-stranded, linear
tccccagcgccgcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcagg

SEQ ID NO: 87 - DNA, 464 bp; single-stranded, linear
ccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatgtaaggtaccgcatgcaagctt

SEQ ID NO: 88 - DNA, 419 bp; single-stranded, linear
ccatggctaactgctctataatgatcgatgaaattatacatcacttaaagagaccacctgcacctttgctggacccgaacaacctcaatgacgaagacgtctctatcctgatggatcgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtggtggttctggcggcggctccaacatgtaaggtaccgcatgcaagctt

SEQ ID NO: 89 - DNA, 405 bp; single-stranded, linear
gccacccaggactgctccttccaacacagccccatctcctccgacttcgctgtcaaaatccgtgagctgtctgactacctgcttcaagattacccagtcaccgtggcctccaacctgcaggacgaggagctctgcggggcgctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagccc

SEQ ID NO: 90 - DNA, 420 bp; single-stranded, linear
gccacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 91 - DNA, 366 bp; single-stranded, linear
gccacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcaggagacctccgagcagctggtggcgctgaagccctggatcactcgccagaacttctcccggtgcctggagctgcagtgtcagcccgactcctcaaccctg

SEQ ID NO: 92 - DNA, 405 bp; single-stranded, linear
ggaactcaggattgttctttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagccc

SEQ ID NO: 93 - DNA, 420 bp; single-stranded, linear
ggtacccaggattgttctttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 94 - DNA, 405 bp; single-stranded, linear
gccactcaggactgttctttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagccc

SEQ ID NO: 95 - DNA, 420 bp; single-stranded, linear
gccactcaggactgctcttttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 96 - DNA, 465 bp; single-stranded, linear
gccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtaacggatccggtggcaatgggagcggcggaaatggaacccaggactgctccttccaacacagccccatctcctccgacttcgctgtcaaaatccgtgagctgtctgactacctgcttcaagattacccagtcaccgtggcctccaacctgcag

SEQ ID NO: 97 - DNA, 450 bp; single-stranded, linear
gccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtcaggcggtaacggcagtggaggtaatggcacccaggactgctccttccaacacagccccatctcctccgacttcgctgtcaaaatccgtgagctgtctgactacctgcttcaagattacccagtcaccgtggcctccaacctgcag

SEQ ID NO: 98 - DNA, 435 bp; single-stranded, linear
gccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggcggcaacggcacccaggactgctccttccaacacagccccatctcctccgacttcgctgtcaaaatccgtgagctgtctgactacctgcttcaagattacccagtcaccgtggcctccaacctgcag

SEQ ID NO: 99 - DNA, 465 bp; single-stranded, linear
gcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtaacggatccggtggcaatgggagcggcggaaatggaacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 100 - DNA, 450 bp; single-stranded, linear
gcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtaacggatccggaggtaatggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 101 - DNA, 435 bp; single-stranded, linear
gcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggcggcaacggcacgcaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 102 - DNA, 465 bp; single-stranded, linear
gccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtaacggcagtggtggcaatgggagcggtggaaatggaacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 103 - DNA, 450 bp; single-stranded, linear
gccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtcaggcggtaacggcagtggaggtaatggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 104 - DNA, 435 bp; single-stranded, linear
gccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggcggcaacggcacgcaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 105 - DNA, 451 bp; single-stranded, linear
gccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtagtggatccggaggttctggcaacccaggactgctccttccaacacagccccatctcctccgacttcgctgtcaaaatccgtgagctgtctgactacctgcttcaagattacccagtcaccgtggcctccaacctgcag

SEQ ID NO: 106 - DNA, 465 bp; single-stranded, linear
gccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtagtggatccggtggcagtgggagcggcggatctggaacccaggactgctccttccaacacagccccatctcctccgacttcgctgtcaaaatccgtgagctgtctgactacctgcttcaagattacccagtcaccgtggcctccaacctgcag

SEQ ID NO: 107 - DNA, 437 bp; single-stranded, linear
ccatggccacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatcc

SEQ ID NO: 108 - DNA, 436 bp; single-stranded, linear
ggatccggaggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtaagctt

SEQ ID NO: 109 - DNA, 449 bp; single-stranded, linear
ccatggccacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtggatcc

SEQ ID NO: 110 - DNA, 439 bp; single-stranded, linear
ggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtaagctt

SEQ ID NO: 111 - DNA, 461 bp; single-stranded, linear
ccatggccacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatcc

SEQ ID NO: 112 - DNA, 457 bp; single-stranded, linear
ggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtaagctt

SEQ ID NO: 113 - DNA, 438 bp; single-stranded, linear
gccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtacccaggactgctccttccaacacagccccatctcctccgacttcgctgtcaaaatccgtgagctgtctgactacctgcttcaagattacccagtcaccgtggcctccaacctgcag

SEQ ID NO: 114 - DNA, 441 bp; single-stranded, linear
gccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggcacccaggactgctccttccaacacagccccatctcctccgacttcgctgtcaaaatccgtgagctgtctgactacctgcttcaagattacccagtcaccgtggcctccaacctgcag

SEQ ID NO: 115 - DNA, 450 bp; single-stranded, linear
gccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtggatccggaggtacccaggactgctccttccaacacagccccatctcctccgacttcgctgtcaaaatccgtgagctgtctgactacctgcttcaagattacccagtcaccgtggcctccaacctgcag

SEQ ID NO: 116 - DNA, 459 bp; single-stranded, linear
gccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcag

SEQ ID NO: 117 - DNA, 465 bp; single-stranded, linear
gccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcag

SEQ ID NO: 118 - DNA, 483 bp; single-stranded, linear
gccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgccttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcag

SEQ ID NO: 119 - DNA, 843 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccacccaggactgctccttccaacacagccccatctcctccgacttcgctgtcaaaatccgtgagctgtctgactacctgcttcaagattacccagtcaccgtggcctccaacctgcaggacgaggagctctgcggggcgctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagccc

SEQ ID NO: 120 - DNA, 858 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccacccaggactgctccttccaacacagccccatctcctccgacttcgctgtcaaaatccgtgagctgtctgactacctgcttcaagattacccagtcaccgtggcctccaacctgcaggacgaggagctctgcggggcgctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 121 - DNA, 888 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtcaggcggtaacggcagtggaggtaatggcacccaggactgctccttccaacacagccccatctcctccgacttcgctgtcaaaatccgtgagctgtctgactacctgcttcaagattacccagtcaccgtggcctccaacctgcag

SEQ ID NO: 122 - DNA, 903 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtaacggatccggtggcaatgggagcggcggaaatggaacccaggactgctccttccaacacagccccatctcctccgacttcgctgtcaaaatccgtgagctgtctgactacctgcttcaagattacccagtcaccgtggcctccaacctgcag

SEQ ID NO: 123 - DNA, 873 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggcggcaacggcacgcaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 124 - DNA, 888 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtaacggatccggaggtaatggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 125 - DNA, 903 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtaacggatccggtggcaatgggagcggcggaaatggaacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 126 - DNA, 873 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggcggcaacggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 127 - DNA, 888 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtcaggcggtaacggcagtggaggtaatggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 128 - DNA, 903 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtaacggcagtggtggtaatgggagcggcggaaatggaacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 129 - DNA, 843 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcgactcaggactgttctttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagccc

SEQ ID NO: 130 - DNA, 858 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcaacccaggactgctcttttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 131 - DNA, 843 bp; single-stranded, linear
gccactcaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagccctacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 132 - DNA, 888 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctcccaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtcaggcggtaacggcagtggaggtaatggcacccaggactgctccttccaacacagccccatctcctccgacttcgctgtcaaaatccgtgagctgtctgactacctgcttcaagattacccagtcaccgtggcctccaacctgcag

SEQ ID NO: 133 - DNA, 903 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtaacggatccggtggcaatgggagcggcggaaatggaacccaggactgctccttccaacacagccccatctcctccgacttcgctgtcaaaatccgtgagctgtctgactacctgcttcaagattacccagtcaccgtggcctccaacctgcag

SEQ ID NO: 134 - DNA, 873 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggcggcaacggcacgcaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 135 - DNA, 888 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtaacggatccggaggtaatggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 136 - DNA, 903 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtaacggatccggtggcaatgggagcggcggaaatggaacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 137 - DNA, 873 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggcggcaacggcacgcaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 138 - DNA, 888 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtcaggcggtaacggcagtggaggtaatggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 139 - DNA, 903 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtaacggcagtggtggcaatgggagcggcggaaatggaacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 140 - DNA, 888 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctcccaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtagtggatccggaggttctggcacccaggactgctccttccaacacagccccatctcctccgacttcgctgtcaaaatccgtgagctgtctgactacctgcttcaagattacccagtcaccgtggcctccaacctgcag

SEQ ID NO: 141 - DNA, 903 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtctggaggtagtggatccggtggcagtgggagcggcggatctggaacccaggactgctccttccaacacagccccatctcctccgacttcgctgtcaaaatccgtgagctgtctgactacctgcttcaagattacccagtcaccgtggcctccaacctgcag

SEQ ID NO: 142 - DNA, 858 bp; single-stranded, linear
gccacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 143 - DNA, 876 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtacccaggactgctccttccaacacagccccatctcctccgacttcgctgtcaaaatccgtgagctgtctgactacctgcttcaagattacccagtcaccgtggcctccaacctgcag

SEQ ID NO: 144 - DNA, 879 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggcacccaggactgctccttccaacacagccccatctcctccgacttcgctgtcaaaatccgtgagctgtctgactacctgcttcaagattacccagtcaccgtggcctccaacctgcag

SEQ ID NO: 145 - DNA, 888 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtggatccggaggtacccaggactgctccttccaacacagccccatctcctccgacttcgctgtcaaaatccgtgagctgtctgactacctgcttcaagattacccagtcaccgtggcctccaacctgcag

SEQ ID NO: 146 - DNA, 897 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcag

SEQ ID NO: 147 - DNA, 903 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcag

SEQ ID NO: 148 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcag

SEQ ID NO: 149 - DNA, 876 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 150 - DNA, 879 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 151 - DNA, 888 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtggatccggaggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 152 - DNA, 897 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 153 - DNA, 903 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 154 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 155 - DNA, 876 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 156 - DNA, 879 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggcacccaggactgctccttccaacacagccccatctcctccgacttcgctgtcaaaatccgtgagctgtctgactacctgcttcaagattacccagtcaccgtggcctccaacctgcaggatgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 157 - DNA, 888 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtggatccggaggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 158 - DNA, 897 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 159 - DNA, 903 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 160 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 161 - DNA, 888 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtggatccggaggtacccaggactgctccttccaacacagccccatctcctccgacttcgctgtcaaaatccgtgagctgtctgactacctgcttcaa

SEQ ID NO: 162 - DNA, 903 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaa

SEQ ID NO: 163 - DNA, 888 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtggatccggaggtacccaggactgctccttccaacacagccccatctcctccgacttcgctgtcaaaatccgtgagctgtctgactacctgcttcaagattacccagtcaccgtg

SEQ ID NO: 164 - DNA, 903 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagaaggcggtggaggctccccgggtgaaccgtctggtccaatctctactatcaacccgtctcctccgtctaaagaatctcataaatctccaaacatggccgcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtg

SEQ ID NO: 165 - DNA, 888 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtggatccggaggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagact

SEQ ID NO: 166 - DNA, 903 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagact

SEQ ID NO: 167 - DNA, 888 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcccgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtggatccggaggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtctt

SEQ ID NO: 168 - DNA, 903 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcccgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtctt

SEQ ID NO: 169 - DNA, 888 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaagctccccgggtgaaccgtctggtccaatctctactatcaacccgtctcctccgtctaaagaatctcataaatctccaaacatggccaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtggatccggaggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccag

SEQ ID NO: 170 - DNA, 903 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccag

SEQ ID NO: 171 - DNA, 876 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtacccaggactgctccttccaacacagccccatctcctccgacttcgctgtcaaaatccgtgagctgtctgactacctgcttcaa

SEQ ID NO: 172 - DNA, 879 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggcacccaggactgctccttccaacacagccccatctcctccgacttcgctgtcaaaatccgtgagctgtctgactacctgcttcaa

SEQ ID NO: 173 - DNA, 897 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggctcagggggaggtagtggtacccaggactgctccttccaacacagccccatctcctccgacttcgctgtcaaaatccgtgagctgtctgactacctgcttcaa

SEQ ID NO: 174 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaa

SEQ ID NO: 175 - DNA, 869 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtactgctccttccaacacagccccatctcctccgacttcgctgtcaaaatccgtgagctgtctgactacctgcttcaagattacccagtcaccgtg

SEQ ID NO: 176 - DNA, 872 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggcactgctccttccaacacagccccatctcctccgacttcgctgtcaaaatccgtgagctgtctgactacctgcttcaagattacccagtcaccgtg

SEQ ID NO: 177 - DNA, 890 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggctcagggggaggtagtggtactgctccttccaacacagccccatctcctccgacttcgctgtcaaaatccgtgagctgtctgactacctgcttcaagattacccagtcaccgtg

SEQ ID NO: 178 - DNA, 917 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtaggactgctccttccaacacagccccatctcctccgacttcgctgtcaaaatccgtgagctgtctgactacctgcttcaagattacccagtcaccgtg

SEQ ID NO: 179 - DNA, 876 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagact

SEQ ID NO: 180 - DNA, 879 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagact

SEQ ID NO: 181 - DNA, 897 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagact

SEQ ID NO: 182 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagact

SEQ ID NO: 183 - DNA, 876 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcccgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtctt

SEQ ID NO: 184 - DNA, 879 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcccgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtctt

SEQ ID NO: 185 - DNA, 897 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcccgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtctt

SEQ ID NO: 186 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcccgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtctt

SEQ ID NO: 187 - DNA, 876 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaagctccccgggtgaaccgtctggtccaatctctactatcaacccgtctcctccgtctaaagaatctcataaatctccaaacatggccaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccag

SEQ ID NO: 188 - DNA, 879 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaagctccccgggtgaaccgtctggtccaatctctactatcaacccgtctcctccgtctaaagaatctcataaatctccaaacatggccaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccag

SEQ ID NO: 189 - DNA, 897 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaagctccccgggtgaaccgtctggtccaatctctactatcaacccgtctcctccgtctaaagaatctcataaatctccaaacatggccaccaacatctcccgcctcctgcaggagacctccgagcagctggtggcgctgaagccctggatcactcgccagaacttctcccggtgcctggagctgcagtgtcagcccgactcctcaaccctgggcggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccag

SEQ ID NO: 190 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccag

SEQ ID NO: 191 - DNA, 2247 bp; single-stranded, linear
ggatccaccatgagccgcctgcccgtcctgctcctgctccaactcctggtccgccccgccatgtctacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgatgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggatggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacgaattcatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttc

SEQ ID NO: 192 - DNA, 1047 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggccacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 193 - DNA, 942 bp; single-stranded, linear
gccactcaggactgctcttttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtacgtagagggcggtggaggctccccgggtgaaccgtctggtccaatctctactatcaacccgtctcctccgtctaaagaatctcataaatctccaaacatggctacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 194 - DNA, 1047 bp; single-stranded, linear
gccacccaggactgctcctttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccatggatcactcgccagaacttctcccggtgcctggagctgcagtgtcagcccgactcctcaaccctgtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttttacgccaccttgcgcagccc

SEQ ID NO: 195 - DNA, 1569 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggccactcaggactgctcttttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtacgtagagggcggtggaggctccccgggtgaaccgtctggtccaatctctactatcaacccgtctcctccgtctaaagaatctcataaatctccaaacatggctacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 196 - DNA, 1380 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccactcaggactgctcttttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtacgtagagggcggtggaggctccccgggtgaaccgtctggtccaatctctactatcaacccgtctcctccgtctaaagaatctcataaatctccaaacatggctacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 197 - DNA, 1569 bp; single-stranded, linear
gccactcaggactgctcttttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtacgtagagggcggtggaggctccccgggtgaaccgtctggtccaatctctactatcaacccgtctcctccgtctaaagaatctcataaatctccaaacatggctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 198 - DNA, 1003 bp; single-stranded, linear
ggccactcaggactgctcttttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtacgtagagggcggtggaggctccccgggtggtggttctggcggcggctccaacatggctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccg

SEQ ID NO: 199 - DNA, 888 bp; single-stranded, linear; identical to SEQ ID NO: 161

SEQ ID NO: 200 - DNA, 903 bp; single-stranded, linear; identical to SEQ ID NO: 162

SEQ ID NO: 201 - DNA, 888 bp; single-stranded, linear; identical to SEQ ID NO: 163

SEQ ID NO: 202 - DNA, 903 bp; single-stranded, linear; identical to SEQ ID NO: 164

SEQ ID NO: 203 - DNA, 888 bp; single-stranded, linear; identical to SEQ ID NO: 165

SEQ ID NO: 204 - DNA, 903 bp; single-stranded, linear; identical to SEQ ID NO: 166

SEQ ID NO: 205 - DNA, 888 bp; single-stranded, linear; identical to SEQ ID NO: 167

SEQ ID NO: 206 - DNA, 903 bp; single-stranded, linear; identical to SEQ ID NO: 168

SEQ ID NO: 207 - DNA, 888 bp; single-stranded, linear; identical to SEQ ID NO: 169

SEQ ID NO: 208 - DNA, 903 bp; single-stranded, linear; identical to SEQ ID NO: 170

SEQ ID NO: 209 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcttctaatctgcaagatgaagagctgtgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcc

SEQ ID NO: 210 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccaacctgcaagatgaagagctgtgtgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctcc

SEQ ID NO: 211 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctctgcaggatgaggaactgtgcggcggcctctggcggctggtcctggcacagcgctggatggagcggctcaagactgtcgctgggtccaagatgcaaggcttgctggagcgcgtgaacacggagatacactttgtcaccaaatgtgcttttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaac

SEQ ID NO: 212 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcaagatgaagagctgtgtggtggtctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctg

SEQ ID NO: 213 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggac

SEQ ID NO: 214 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgagctgtgtggtggcctgtggcgtctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccaaaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgag

SEQ ID NO: 215 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctctgtgcggtggtctgtggcgtctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggag

SEQ ID NO: 216 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggcttctaatctgcaagatgaagagctgtgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgactccgctgtcaaaatccgtgagctgtctgactacctgcttcaagattacccagtcaccgtggcc

SEQ ID NO: 217 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctcaagatgaagaactgtgcggtggtctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcgggagacctccgagcagccggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctg

SEQ ID NO: 218 - DNA, 921 bp; single-stranded, linear
gctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctctgtgcggtggtctgtggcgtctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcggcccgactcctcaaccctgggcggtgggtcaggaggtgggtcaggaggtggatccggaggtggctcagggggaggtagtggtacccaggactgctccttccaacacagccccatctcctccgacttcgctgtcaagatccgtgagctgtctgactacctgcttcaagattacccagtcaccgtggcctccaacctgcaggacgaggag

SEQ ID NO: 219 - DNA, 906 bp; single-stranded, linear
gctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtgtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 220 - DNA, 888 bp; single-stranded, linear
gcggatgaggagctgtgcggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaggccctggatcactcgccagaacttctcccggtgcctggagctgcagtgtcagcccgactcctcaaccctgggcggtgggtcaggaggtggatccggaggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 221 - DNA, 903 bp; single-stranded, linear
gccgacgaggagctgtgcggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggaacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 222 - DNA, 921 bp; single-stranded, linear
gcagacgaggagctgtgcggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 223 - DNA, 903 bp; single-stranded, linear
gcggacgaggagctgtgcggtggcctctggcggctggtcctggcacagcgctggatggagcggctcaagactgtcgctgggtccaagatgcaaggcctgctggagcgcgtgaacacggagatacactttgtcaccaaatgtgcctttcagcccccccccagctgtcttcgcctcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggaacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 224 - DNA, 921 bp; single-stranded, linear
gcggatgaggagctgtgtggtggcctctggcggctggtcctggcacagcgctggatggggcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 225 - DNA, 904 bp; single-stranded, linear
ggccgattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaatacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 226 - DNA, 903 bp; single-stranded, linear
gccgcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtgtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 227 - DNA, 903 bp; single-stranded, linear
gccgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaggattacccagtcaccgtggcctccaacctgcaggacgaggagctctgcgggggcctctggcggctggtcctggcacagcgctggatggagcggctcaagacttacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 228 - DNA, 903 bp; single-stranded, linear
gcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggctacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 229 - DNA, 903 bp; single-stranded, linear
gccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccgtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 230 - DNA, 903 bp; single-stranded, linear
gccaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttygctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 231 - DNA, 903 bp; single-stranded, linear
gcccgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggaacgcgtgaacacggagatacactttgtcaccaaatgtgcctttcagcccccccccagctgtttttacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 232 - DNA, 921 bp; single-stranded, linear
gcttcaaatctgcaggatgaagagctgtgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 233 - DNA, 921 bp; single-stranded, linear
gctaatctgcaagatgaggagctgtgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctcctacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 234 - DNA, 921 bp; single-stranded, linear
gcgctgcaggatgaagagctgtgtggcggcctctggcggctggtcctggcacagcgcttgatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaactacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 235 - DNA, 921 bp; single-stranded, linear
gcgcaagatgaggaactgtgtggtggtctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgtacgtagagggcggtggaggctccccgggtgaaccgtctggtccaatctctactatcaacccgtctcccccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 236 - DNA, 921 bp; single-stranded, linear
gctgaagaactgtgtggtggcctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggactacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 237 - DNA, 921 bp; single-stranded, linear
gctctgtgcggtggcctgtggcgtctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 238 - DNA, 921 bp; single-stranded, linear
gcactgtgtggtggtctgtggcgtctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 239 - DNA, 921 bp; single-stranded, linear
gctctgtgtggcggtctgtggcgtctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcggcccgactcctcaaccctgggcggtgggtcaggaggtgggtcaggaggtggatccggaggtggctcagggggaggtagtggtacccaggactgctccttccaacacagccccatctcctccgacttcgctgtcaagatccgtgagctgtctgactacctgcttcaagattacccagtcaccgtggcctccaacctgcaggacgaggagtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 240 - DNA, 903 bp; single-stranded, linear; identical to SEQ ID NO: 228

SEQ ID NO: 241 - DNA, 945 bp; single-stranded, linear
gctcaagatgatgagctgtgtggtggtctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggcggtggttctggcggaggatccggcggcggaagcggaggtggctctgggggaggtagtggtacccaggactgctccttccaacacagccccatctcctccgacttcgctgtcaaaatccgtgagctgtctgactacctgcttcaagattacccagtcaccgtggcctccaacctgtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 242 - DNA, 903 bp; single-stranded, linear
gcccaagatgaagaactgtgtggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccgccaccgtggagcccgcgtccactcggcgccaccgcaccgaccacccaggactgctccttccaacacagccccatctcctccgacttcgctgtcaaaatccgtgagctgtctgactacctgcttcaagattacccagtcaccgtggcctccaacctgtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 243 - DNA, 921 bp; single-stranded, linear
gcccaagatgaagaactgtgtggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccgccaccgtggagcccgcgtccactcggcgccaccgcaccgaccgctggacaaccgcctctgacccaggactgctccttccaacacagccccatctcctccgacttcgctgtcaaaatccgtgagctgtctgactacctgcttcaagattacccagtcaccgtggcctccaacctgtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacag

SEQ ID NO: 244 - DNA, 1110 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcag

SEQ ID NO: 245 - DNA, 1110 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggcaaatctgcaagacgaggagctgtgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagatcaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctcc

SEQ ID NO: 246 - DNA, 1110 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 247 - DNA, 1110 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctctgcaggatgaggaactgtgcggcggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaac

SEQ ID NO: 248 - DNA, 1110 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctcaagatgaagagctgtgtggtggtctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctg

SEQ ID NO: 249 - DNA, 1110 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggac

SEQ ID NO: 250 - DNA, 1110 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctgagctgtgtggtggcctgtggcgtctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgag

SEQ ID NO: 251 - DNA, 1110 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctctgtgcggtggtctgtggcgtctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggag

SEQ ID NO: 252 - DNA, 1092 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctgatgaagaactgtgtggtgggctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccgccaccgtggagcccgcgtccactcggcgccaccgcaccgaccacccaggactgctccttccaacacagccccatctcctccgacttcgctgtcaaaatccgtgagctgtctgactacctgcttcaagattacccagtcaccgtggcctccaacctgcag

SEQ ID NO: 253 - DNA, 1134 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctgatgaagaactgtgtggtgggctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggcggtggttctggcggaggatccggcggcggaagcggaggtggctctgggggaggtagtggtacccaggactgctccttccaacacagccccatctcctccgacttcgctgtcaaaatccgtgagctgtctgactacctgcttcaagattacccagtcaccgtggcctccaacctgcag

SEQ ID NO: 254 - DNA, 1110 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctgatgaagaactgtgtggtgggctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccgccaccgtggagcccgcgtccactcggcgccaccgcaccgaccgctggacaaccgcctctgacccaggactgctccttccaacacagccccatctcctccgacttcgctgtcaaaatccgtgagctgtctgactacctgcttcaagattacccagtcaccgtggcctccaacctgcag

SEQ ID NO: 255 - DNA, 465 bp; single-stranded, linear
gccgattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaa

SEQ ID NO: 256 - DNA, 465 bp; single-stranded, linear
gccgcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtg

SEQ ID NO: 257 - DNA, 465 bp; single-stranded, linear
gccgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagact

SEQ ID NO: 258 - DNA, 465 bp; single-stranded, linear
gcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggg

SEQ ID NO: 259 - DNA, 465 bp; single-stranded, linear
gccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccc

SEQ ID NO: 260 - DNA, 465 bp; single-stranded, linear
gcccgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtctt

SEQ ID NO: 261 - DNA, 465 bp; single-stranded, linear
gccaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccag

SEQ ID NO: 262 - DNA, 1110 bp; single-stranded, linear
gctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 263 - DNA, 1110 bp; single-stranded, linear
gcagatgaagaactgtgtgggggactgtggcgtctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 264 - DNA, 1062 bp; single-stranded, linear
gctgatgaagaactgtgtggtgggctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccgccaccgtggagcccgcgtccactcggcgccaccgcaccgaccgctggacaaccgcctctgacccaggactgctccttccaacacagccccatctcctccgacttcgctgtcaaaatccgtgagctgtctgactacctgcttcaagattacccagtcaccgtggcctccaacctgtacgtagagggcggtggaggctccccgggtggtggttctggcggcggctccaacatggctacaccattgggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccg

SEQ ID NO: 265 - DNA, 1089 bp; single-stranded, linear
gctgatgaagaactgtgtggtgggctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggcggtggttctggcggaggatccggcggcggaagcggaggtggctctgggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtggtggttctggcggcggctccaacatggctacaccattgggccctgccagctccctgccccagagcttcctgctcaagtctttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccg

SEQ ID NO: 266 - DNA, 1044 bp; single-stranded, linear
gctgatgaagaactgtgtggtgggctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccgccaccgtggagcccgcgtccactcggcgccaccgcaccgaccacccaggactgctccttccaacacagccccatctcctccgacttcgctgtcaaaatccgtgagctgtctgactacctgcttcaagattacccagtcaccgtggcctccaacctgtacgtagagggcggtggaggctccccgggtggtggttctggcggcggctccaacatggctacaccattgggccctgccagctccctgccccagagcttcctgctcaagtctttagagcaagtgagraagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccg

SEQ ID NO: 267 - DNA, 1077 bp; single-stranded, linear
gcggatgaggagctgtgcggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaggccctggatcactcgccagaacttctcccggtgcctggagctgcagtgtcagcccgactcctcaaccctgggcggtgggtcaggaggtggatccggaggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 268 - DNA, 1092 bp; single-stranded, linear
gccgacgaggagctgtgcggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 269 - DNA, 1110 bp; single-stranded, linear
gcagacgaggagctgtgcggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttgtacgccaccttgcgcagccc

SEQ ID NO: 270 - DNA, 1092 bp; single-stranded, linear
gccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagccgtacgtagagggcggtggaggctccccgggtgaaccgtctggtccaatctctactatcaacccgtctcctccgtctaaagaatctcataaatctccaaacatggctacaccattaggccctgccagctccgtgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttatacgccaccttgcgcagccc

SEQ ID NO: 271 - DNA, 1110 bp; single-stranded, linear
gcttcaaatctgcaggatgaagagctgtgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctacgtagagggcggtggaggctccccgggtgaaccgtctggtccaatctctactatcaacccgtctcatccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 272 - DNA, 1110 bp; single-stranded, linear
gctaatctgcaagatgaggagctgtgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctcctacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttatacgccaccttgcgcagccc

SEQ ID NO: 273 - DNA, 1110 bp; single-stranded, linear
gcgctgcaggatgaagagctgtgtggcggcctctggcggctggtcctggcacagcgcttgatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaactacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 274 - DNA, 1110 bp; single-stranded, linear
gcactgtgcggtggtctgtggcgtctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctacagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgaggagtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 275 - DNA, 1092 bp; single-stranded, linear
gcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggctacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 276 - DNA, 1092 bp; single-stranded, linear; identical to SEQ ID NO: 275

SEQ ID NO: 277 - DNA, 1110 bp; single-stranded, linear
gcgctgtgtggtggtctgtggcgtctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcggcccgactcctcaaccctgggcggtgggtcaggaggtgggtcaggaggtggatccggaggtggctcagggggaggtagtggtacccaggactgctccttccaacacagccccatctcctccaacttcgctgtcaagatccgtgagctgtctgactacctgcttcaagattacccagtcaccgtggcctccaacctgcaggacgaggagtacgtagagggcggtggaggctccccgggtgaaccgtctggtccaatttttactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 278 - DNA, 1110 bp; single-stranded, linear
gctgaactgtgtggtggtctgtggcgtctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggacgagtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 279 - DNA, 1110 bp; single-stranded, linear
gctgaagaactgtgtggtggcctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggactacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 280 - DNA, 1110 bp; single-stranded, linear
gctcaggacgaggaactgtgtggtggtctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 281 - DNA, 1092 bp; single-stranded, linear
gccaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgactttgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 282 - DNA, 1065 bp; single-stranded, linear
gctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtggtggttctggcggcggctccaacatggctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccg

SEQ ID NO: 283 - DNA, 1110 bp; single-stranded, linear
gctcaagatgaagaactgtgcggtggtctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggcggatccggaggtggctcagggggaggtagtggtacccaggactgctccttccaacacagccccatctcctccgactccgctgtcaaaatccgtgagctgtctgactacctgcttcaagattacccagtcaccgtggcctccaacctgtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 284 - DNA, 1098 bp; single-stranded, linear
gcgctgtgtggtggcctgtggcgtctggtcctggcacagcgctggatggagcggctcaagactgtcgctgggtccaagatgcaaggcttgctggagcgcgtgaacacggagatacactttgtcaccaaatatgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcggcccgactcctcaaccctgggcggtgggtcaggaggtggatccggaggtggctcagggggaggtagtggtacccaggactgctccttccaacacagccccatctcctccgacttcgctgtcaagatccgtgagctgtctgactacctgcttcaagattacccagtcaccgtggcctccaacctgcaggacgaggagtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 285 - DNA, 1092 bp; single-stranded, linear
gcctccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttcttccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctggctacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 286 - DNA, 1134 bp; single-stranded, linear
gctcaagacgaagaactgtgtggtggtctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggcggtggttctggcggaggatccggcggcggaagcggaggtggctctgggggaggtagtggtacccaggactgctccttccaacacagccccatctcctccgacttcgctgtcaaaatccgtgagctgtctgactacctgcttcaagattacccagtcaccgtggcctccaacctgtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 287 - DNA, 1092 bp; single-stranded, linear
gcccaagatgaagaactgtgtggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccgccaccgtggagcccgcgtccactcggcgccaccgcaccgaccacccaggactgctccttccaacacagccccatctcctccgacttcgctgtcaaaatccgtgagctgtctgactacctgcttcaagattacccagtcaccgtggcctccaacctgtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 288 - DNA, 1110 bp; single-stranded, linear
gcccaagatgaagaactgtgtggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccgccaccgtggagcccgcgtccactcggcgccaccgcaccgaccgctggacaaccgcctctgacccaggactgctccttccaacacagccccatctcctccgacttcgctgtcaaaatccgtgagctgtctgactacctgcttcaagattacccagtcaccgtggcctccaacctgtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 289 - DNA, 1134 bp; single-stranded, linear
gctgatgaagaactgtgtggtgggctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggcggtggttctggcggaggatccggcggcggaagcggaggtggctctgggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 290 - DNA, 1134 bp; single-stranded, linear
gctgatgaagaactgtgtggtgggctgtggcggctggtcctggcacagcgctggatggagcggcccaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggcggtggttctggcggaggatccggcggcggaagcggaggtggctctgggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 291 - DNA, 1110 bp; single-stranded, linear
gcggacgaggagctgtgcggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccgccaccgtggagcccgcgtccactcggcgccaccgcaccgaccgctggacaaccgcctctgacccaggactgctccttccaacacagccccatctcctccgacttcgctgtcaaaatccgtgagctgtctgactacctgcttcaagattacccagtcaccgtggcctccaacctgcagtacgtagagggcggtggaggcaccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccc

SEQ ID NO: 292 - DNA, 1041 bp; single-stranded, linear
gctgatgaggagctgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgtagagacggtgtttcaccgtgtcagccaggatggtctagatctcctgacctcgacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtggtggttctggcggcggctccaacatggctacaccattgggccctgccagctccctgccccagagcttcctgctcaagtctttagagcaagtgagaaagatccagggcgatggcgcagcgctccaggagaagctgtgtgccactaacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccg

SEQ ID NO: 293 - DNA, 1152 bp; single-stranded, linear
gctgatgaagaactgtgtggtgggctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtacgtagagggcggtggaggctccccgggtgaaccgtctggtccaatctctactatcaacccgtctcctccgtctaaagaatctcataaatctccaaacatggctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggcaacccaggactgctcttttcaacacagccccatctcctccgacttcgctgtcaaaatccgtgagctgtctgactacctgcttcaagattacccagtcaccgtggcctccaacctgcag

SEQ ID NO: 294 - DNA, 1047 bp; single-stranded, linear
gccacccaggactgctcctttcaacacagccccatctcctccgacttcgctgtcaaaatccgtgagctgtctgactacctgcttcaagattacccagtcaccgtggcctccaacctgcaggagccgaagagcccggacacccatactagtccgccatctccgacaccattaggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggccccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctgcagaaccgaaatctccggatactcataccagcccgccatccccgggttctaatctgcaagatgaagagctgtgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgccttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 295 - DNA, 1043 bp; single-stranded, linear
gccacccaggactgctcctttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggctggcaggggcgcgtgaacacggagatacactttgtcaccaaatgtgcctttccgaagagcccggacacccatactagtccgccatctccgggtacaccattgggccctgccagctccctgccccagagcttcctgctcaagtctttagagcaagtgagaaagatccagggcgatggcgcagcgctccaggagaagctgtgtgccactacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctctgcagaaccgaaatctccggatactcataccagcccgccatccccgggtaaggcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 296 - DNA, 1065 bp; single-stranded, linear
gctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatctgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactcctccttccaacacagccccatctcctccgacttcgctgtcaaaatccgtgagctgtctgactacctgcttcaagattacccagtcaccgtggcctccaacctgcagtacgtagagggcggtggaggctccccgggtggtggttctggcggcggctccaacatggctacaccattgggccctgccagctccctgccccagagcttcctgctcaagtctttagagcaagtgagaaagatccagggcgatggcgcagcgctccaggagaagctgtgtgccactaacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccg

SEQ ID NO: 297 - DNA, 1110 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatctgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactcctccttccaacacagccccatctcctccgacttcgctgtcaaaatccgcgagctgtctgactacctgcttcaagattacccagtcaccgtggcctccaacctgcag

SEQ ID NO: 298 - DNA, 1065 bp; single-stranded, linear
gctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctctcttcgcttcgtccagaccaacatctcccgcctcctgcaggagacctccgagcagctggtggcgctgaagccctggatcactcgccagaacttctcccggtgcctagagctgcagtctcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtggtggttctggcggcggctccaacatggctacaccattgggccctgccagctccctgccccagagcttcctgctcaagtctttagagcaagtgagaaagatccagggcgatggcgcagcgctccaggagaagctgtgtgccactaacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccg

SEQ ID NO: 299 - DNA, 1110 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggcagatgaagaactgtgtgggggcctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctctcttcgcttcgtccagaccaacatctcccgcctcctgcaggagacctccgagcagctggtggcgctgaagccctggatcactcgccagaacttctcccggtgcctggagctgcagtctcagcccgactcctcaaccctgggcggtgggtcaggaggtgggtcaggaggtggatccggaggtggctcagggggaggtagtggtactcaggactgttcttttcaacacagccccatctcctccgacttcgctgtcaaaatccgtgagctgtctgactacctgcttcaagattacccagtcaccgtggcctccaacctgcag

SEQ ID NO: 300 - DNA, 1002 bp; single-stranded, linear
gccactcaggactcctcttttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatctgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgtacgtagagggcggtggaggctccccgggtggtggttctggcggcggctccaacatggctacaccattgggccctgccagctccctgccccagagcttcctgctcaagtctttagagcaagtgagaaagatccagggcgatggcgcagcgctccaggagaagctgtgtgccactaacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccg

SEQ ID NO: 301 - DNA, 1002 bp; single-stranded, linear
gccactcaggactgttcttttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctctcttcgcttcgtccagaccaacatctcccgcctcctgcaggagacctccgagcagctggtggcgctgaagccctggatcactcgccagaacttctcccggtgcctggagctgcagtctcagcccgactcctcaaccctgtacgtagagggcggtggaggctccccgggtggtggttctggcggcggctccaacatggctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccg

SEQ ID NO: 302 - DNA, 978 bp; single-stranded, linear
gccactcaggactgttcttttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtacgtagagggcggtggaggctccccgggtggtggttctggcggcggctccaacatggctacaccattgggccctgccagctccctgccccagagcttcctgctcaagtctttagagcaagtgagaaagatccagggcgatggcgcagcgctccaggagaagctgtgtgccactaacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccg

SEQ ID NO: 303 - DNA, 1002 bp; single-stranded, linear
gccactcaggactgttcttttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtctcagcccgactcctcaaccctgtacgtagagggcggtggaggctccccgggtggtggttctggcggcggctccaacatggctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccg

SEQ ID NO: 304 - DNA, 1001 bp; single-stranded, linear
gccactcaggactgttcttttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggcgcctggagctgcagtctcagcccgactcctcaaccctgtacgtagagggcggtggaggctccccgggtggtggttctggcggcggctccaacatggctacaccattgggccctgccagctccctgccccagagcttcctgctcaagtctttagagcaagtgagaaagatccagggcgatggcgcagcgctccaggagaagctgtgtgccactaacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagcc

SEQ ID NO: 305 - DNA, 1056 bp; single-stranded, linear
gctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtggtggttctggcggcggctccaacatggctactcaaggtgctatgccagcttttgcttctgcttttcaacgtcgtgcaggtggtgttctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccc

SEQ ID NO: 306 - DNA, 1101 bp; single-stranded, linear
gctactcaaggtgctatgccagcttttgcttctgcttttcaacgtcgtgcaggtggtgttctggttgctagccatctgcagagcttcctggaggtgtcgtaccgcgttctacgccaccttgcgcagccctctggcggctctggcggctctcagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagccctacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcag

SEQ ID NO: 307 - DNA, 1032 bp; single-stranded, linear
gccgacgaggagctgtgcggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggaacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcag

SEQ ID NO: 308 - DNA, 1005 bp; single-stranded, linear
gctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctacccaggactgctccttccaacacagccccatctcctccgacttcgctgtcaaaatccgtgagctgtctgactacctgcttcaaaattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 309 - DNA, 1650 bp; single-stranded, linear
gctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtggtggttctggcggcggctccaacatggctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcag

SEQ ID NO: 310 - DNA, 1632 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctg

SEQ ID NO: 311 - DNA, 1695 bp; single-stranded, linear
gctacaccattgggccctgccagctccctgccccagagcttcctgctcaagtctttagagcaagtgagaaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctacgtagagggcggtggaggctccccgggtgaaccgtctggtccaatctctactatcaacccgtctcctccgtctaaagaatctcataaatctccaaacatggctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcag

SEQ ID NO: 312 - DNA, 1506 bp; single-stranded, linear
gctaactgctctataatgatcgatgaaattatacatcacttaaagagaccacctgcacctttgctggacccgaacaacctcaatgacgaagacgtctctatcctgatggaccgaaaccttcgacttccaaacctggagagcttcgtaagggctgtcaagaacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcag

SEQ ID NO: 313 - DNA, 1674 bp; single-stranded, linear
gctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtggtggttctggcggcggctccaacatggctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctacaccattaggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagctcctgccccagccaggccctgcagctggcaggctgcttgagccaactccatagcggccttttcctctaccaggggctcctgcaggccctggaagggatatcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgctagccatctgcagagcttcctggaggtgtcgtaccgcgttctacgccaccttgcgcagccctgataaggatccgaattcggcagc

SEQ ID NO: 314 - DNA, 1470 bp; single-stranded, linear
gccgacgaggagctgtgcggtggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggaacccaggactgctccttccaacacagccccatctcctccgacttcgctgtcaaaatccgtgagctgtctgactacctgcttcaagattacccagtcaccgtggcctccaacctgcagtacgtagagggcggtggaggctccccgggtgaaccgtctggtccaatctctactatcaacccgtctcctccgtctaaagaatctcataaatctccaaacatggctaactgctctataatgatcgatgaaattatacatcacttaaagagaccacctaaccctttgctggacccgaacaacctcaattctgaagacatggatatcctgatggaacgaaaccttcgaactccaaacctgctcgcattcgtaagggctgtcaagcacttagaaaatgcatcaggtattgaggcaattcttcgtaatctccaaccatgtctgccctctgccacggccgcaccctctcgacatccaatcatcatcaaggcaggtgactggcaagaattccgggaaaaactgacgttctatctggttacccttgagcaagcgcaggaacaacagtacgtagagggcggtggaggctccccgggtgaaccgtctggtccaatctctactatcaacccgtctcctccgtctaaagaatctcataaatctccaaacatggccgacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggcacccaggactgctccttccaacacagccccatctcctccgacttcgctgtcaaaatccgtgagctgtctgactacctgcttcaagattacccagtcaccgtggcctccaacctgcag

SEQ ID NO: 315 - DNA, 1194 bp; single-stranded, linear
gctgatgaagaactgtgtggtggtctgtggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgggcggtgggtcaggaggtgggtcaggaggtggatccggaggtggctcagggggaggtagtggtacccaggactgctccttccaacacagccccatctcctccgacttcgctgtcaaaatccgtgagctgtctgactacctgcttcaagattacccagtcaccgtggcctccaacctgcaggaattcaagcttgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggcggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 316 - DNA, 1131 bp; single-stranded, linear
gccacccaggactgctcctttcaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctggaattcaagcttgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggcggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 317 - DNA, 45 bp; single-stranded, linear
acgtccatggcntcnccngcnccncctgcttgtgcactccgagtc

SEQ ID NO: 318 - DNA, 30 bp; single-stranded, linear
atgcacgaattccctgacgcagagggtgga

SEQ ID NO: 319 - DNA, 33 bp; single-stranded, linear
tgacaagcttacctgacgcagagggtggaccct

SEQ ID NO: 320 - DNA, 10 bp; single-stranded, linear
aattcggcaa

SEQ ID NO: 321 - DNA, 10 bp; single-stranded, linear
catgttgccg

SEQ ID NO: 322 - DNA, 13 bp; single-stranded, linear
aattcggcggcaa

SEQ ID NO: 323 - DNA, 13 bp; single-stranded, linear
catgttgccgccg

SEQ ID NO: 324 - DNA, 22 bp; single-stranded, linear
aattcggcggcaacggcggcaa

SEQ ID NO: 325 - DNA, 22 bp; single-stranded, linear
catgttgccgccgttgccgccg

SEQ ID NO: 326 - DNA, 27 bp; single-stranded, linear
cgatccatggaggttcaccctttgcct

SEQ ID NO: 327 - DNA, 29 bp; single-stranded, linear
gatcaagcttatgggcactggctcagtct

SEQ ID NO: 328 - DNA, 27 bp; single-stranded, linear
cgatacatgttgcctacacctgtcctg

SEQ ID NO: 329 - DNA, 29 bp; single-stranded, linear
gatcaagcttaagggtgaacctctgggca

SEQ ID NO: 330 - DNA, 27 bp; single-stranded, linear
cgatccatggtcctgctgcctgctgtg

SEQ ID NO: 331 - DNA, 29 bp; single-stranded, linear
gatcaagcttaaggtgtaggcaaagggtg

SEQ ID NO: 332 - DNA, 30 bp; single-stranded, linear
cgatccatggctgtggactttagcttggga

SEQ ID NO: 333 - DNA, 29 bp; single-stranded, linear
gatcaagcttaaggcagcaggacaggtgt

SEQ ID NO: 334 - DNA, 27 bp; single-stranded, linear
cgatccatggactttagcttgggagaa

SEQ ID NO: 335 - DNA, 29 bp; single-stranded, linear
gatcaagcttacacagcaggcagcaggac

SEQ ID NO: 336 - DNA, 27 bp; single-stranded, linear
cgatccatgggagaatggaaaacccag

SEQ ID NO: 337 - DNA, 29 bp; single-stranded, linear
gatcaagcttacaagctaaagtccacagc

SEQ ID NO: 338 - DNA, 27 bp; single-stranded, linear
cgatccatgggacccacttgcctctca

SEQ ID NO: 339 - DNA, 29 bp; single-stranded, linear
gatcaagcttacagttgtccccgtgctgc

SEQ ID NO: 340 - DNA, 27 bp; single-stranded, linear
cagtccatgggaacccagcttcctcca

SEQ ID NO: 341 - DNA, 29 bp; single-stranded, linear
gatcaagcttaaaggaggctctgcagggc

SEQ ID NO: 342 - DNA, 27 bp; single-stranded, linear
cgatccatgggcaggaccacagctcac

SEQ ID NO: 343 - DNA, 30 bp; single-stranded, linear
gatcaagcttactgtggaggaagctgggtt

SEQ ID NO: 344 - DNA, 30 bp; single-stranded, linear
cgatccatggctcacaaggatcccaatgcc

SEQ ID NO: 345 - DNA, 29 bp; single-stranded, linear
gatcaagcttatgtggtcctgccctgtgg

SEQ ID NO: 346 - DNA, 30 bp; single-stranded, linear
cgatccatggatcccaatgccatcttcctg

SEQ ID NO: 347 - DNA, 29 bp; single-stranded, linear
gatcaagcttacttgtgagctgtggtcct

SEQ ID NO: 348 - DNA, 30 bp; single-stranded, linear
cgatccatggccatcttcctgagcttccaa

SEQ ID NO: 349 - DNA, 32 bp; single-stranded, linear
gatcaagcttaattgggatccttgtgagctgt

SEQ ID NO: 350 - DNA, 83 bp; single-stranded, linear
aattccgtcgtaaactgaccttctatctgaaaaccttggagaacgcgcaggctcaacagtacgtagagggcggtggaggctcc

SEQ ID NO: 351 - DNA, 83 bp; single-stranded, linear
ccggggagcctccaccgccctctacgtactgttgagcctgcgcgttctccaaggttttcagatagaaggtcagtttacgacgg

SEQ ID NO: 352 - DNA, 59 bp; single-stranded, linear
gttacccttgagcaagcgcaggaacaacagggtggtggctctaactgctctataatgat

SEQ ID NO: 353 - DNA, 56 bp; single-stranded, linear
cgatcattatagagcagttagagccaccaccctgttgttcctgcgcttgctcaagg

SEQ ID NO: 354 - DNA, 83 bp; single-stranded, linear
gttacccttgagcaagcgcaggaacaacagggtggtggctctggcggtggcagcggcggcggttctaactgctctataatgat

SEQ ID NO: 355 - DNA, 80 bp; single-stranded, linear
cgatcattatagagcagttagaaccgccgccgctgccaccgccagagccaccaccctgttgttcctgcgcttgctcaagg

SEQ ID NO: 356 - DNA, 32 bp; single-stranded, linear
gatcgaccatggctctggacccgaacaacctc

SEQ ID NO: 357 - DNA, 28 bp; single-stranded, linear
ctcgattacgtacaaaggtgcaggtggt

SEQ ID NO: 358 - DNA, 32 bp; single-stranded, linear
gatcgaccatggctaatgcatcaggtattgag

SEQ ID NO: 359 - DNA, 28 bp; single-stranded, linear
ctcgattacgtattctaagttcttgaca

SEQ ID NO: 360 - DNA, 32 bp; single-stranded, linear
gatcgaccatggctgcaccctctcgacatcca

SEQ ID NO: 361 - DNA, 28 bp; single-stranded, linear
ctcgattacgtaggccgtggcagagggc

SEQ ID NO: 362 - DNA, 32 bp; single-stranded, linear
gatcgaccatggctgcaggtgactggcaagaa

SEQ ID NO: 363 - DNA, 28 bp; single-stranded, linear
ctcgattacgtacttgatgatgattgga

SEQ ID NO: 364 - DNA, 54 bp; single-stranded, linear
gctctgagagccgccagagccgccagagggctgcgcaaggtggcgtagaacgcg

SEQ ID NO: 365 - DNA, 54 bp; single-stranded, linear
cagccctctggcggctctggcggctctcagagcttcctgctcaagtctttagag

SEQ ID NO: 366 - DNA, 18 bp; single-stranded, linear
gggctgcgcaaggtggcg

SEQ ID NO: 367 - DNA, 21 bp; single-stranded, linear
acaccattgggccctgccagc

SEQ ID NO: 368 - DNA, 32 bp; single-stranded, linear
gatcgaccatggcttacaagctgtgccacccc

SEQ ID NO: 369 - DNA, 36 bp; single-stranded, linear
cgatcgaagcttattaggtggcacacagcttctcct

SEQ ID NO: 370 - DNA, 32 bp; single-stranded, linear
gatcgaccatggctcccgagttgggtcccacc

SEQ ID NO: 371 - DNA, 36 bp; single-stranded, linear
cgatcgaagcttattaggatatcccttccagggcct

SEQ ID NO: 372 - DNA, 32 bp; single-stranded, linear
gatcgaccatggctatggcccctgccctgcag

SEQ ID NO: 373 - DNA, 36 bp; single-stranded, linear
cgatcgaagcttattatcccagttcttccatctgct

SEQ ID NO: 374 - DNA, 32 bp; single-stranded, linear
gatcgaccatggctacccagggtgccatgccg

SEQ ID NO: 375 - DNA, 36 bp; single-stranded, linear
cgatcgaagcttattagggctgcagggcaggggcca

SEQ ID NO: 376 - DNA, 32 bp; single-stranded, linear
gatcgaccatggcttctgctttccagcgccgg

SEQ ID NO: 377 - DNA, 36 bp; single-stranded, linear
cgatcgaagcttattaggcgaaggccggcatggcac

SEQ ID NO: 378 - DNA, 21 bp; single-stranded, linear
gtagagggcggtggaggctcc

SEQ ID NO: 379 - DNA, 25 bp; single-stranded, linear
ccggggagcctccaccgccctctac

SEQ ID NO: 380 - DNA, 53 bp; single-stranded, linear
ttctacgccaccttgcgcagcccggcggcggctctgacatgtctacaccattg

SEQ ID NO: 381 - DNA, 53 bp; single-stranded, linear
caatggtgtagacatgtcagagccgccgccgggctgcgcaaggtggcgtagaa

SEQ ID NO: 382 - DNA, 37 bp; single-stranded, linear
gtcagaccatggccgattacccagtcaccgtggcctc

SEQ ID NO: 383 - DNA, 37 bp; single-stranded, linear
gtcagcccatggccgcctccaacctgcaggacgagga

SEQ ID NO: 384 - DNA, 38 bp; single-stranded, linear
gtcagaccatggccgtcgctgggtccaagatgcaaggc

SEQ ID NO: 385 - DNA, 38 bp; single-stranded, linear
gtcagaccatggcccgcttcgtccagaccaacatctcc

SEQ ID NO: 386 - DNA, 38 bp; single-stranded, linear
gtcagaccatggccaccaacatctcccgcctcctgcag

SEQ ID NO: 387 - DNA, 39 bp; single-stranded, linear
tctgacaagcttattgaagcaggtagtcagacagctcac

SEQ ID NO: 388 - DNA, 38 bp; single-stranded, linear
tctgacaagcttacacggtgactgggtaatcttgaagc

SEQ ID NO: 389 - DNA, 37 bp; single-stranded, linear
tctgacaagcttaagtcttgagccgctccatccagcg

SEQ ID NO: 390 - DNA, 32 bp; single-stranded, linear
gtcaagaagcttacggctgaaaggcacatttg

SEQ ID NO: 391 - DNA, 36 bp; single-stranded, linear
tctgacaagcttaaagacagctgggggggggctgaa

SEQ ID NO: 392 - DNA, 37 bp; single-stranded, linear
ctcgacaagcttactggacgaagcgaagacagctggg

SEQ ID NO: 393 - DNA, 57 bp; single-stranded, linear
gttgccatggcntcnaayctgcargaygargarctgtgcgggggcctctggcggctg

SEQ ID NO: 394 - DNA, 57 bp; single-stranded, linear
gttgccatggcnaayctgcargaygargarctgtgygggggcctctggcggctggtc

SEQ ID NO: 395 - DNA, 57 bp; single-stranded, linear
gttgccatggcnctgcargaygargarctgtgyggyggcctctggcggctggtcctg

SEQ ID NO: 396 - DNA, 57 bp; single-stranded, linear
gttgccatggcncargaygargarctgtgyggyggyctctggcggctggtcctggca

SEQ ID NO: 397 - DNA, 57 bp; single-stranded, linear
gttgccatggcngaygargarctgtgyggyggyctctggcggctggtcctggcacag

SEQ ID NO: 398 - DNA, 57 bp; single-stranded, linear
gttgccatggcngargarctgtgyggyggyctctggcggctggtcctggcacagcgc

SEQ ID NO: 399 - DNA, 57 bp; single-stranded, linear
gttgccatggcngarctgtgyggyggyctgtggcgyctggtcctggcacagcgctgg

SEQ ID NO: 400 - DNA, 57 bp; single-stranded, linear
gttgccatggcnctgtgyggyggyctgtggcgyctggtcctggcacagcgctggatg

SEQ ID NO: 401 - DNA, 42 bp; single-stranded, linear
gttgccatggcwgatgaagaactgtgtggnggnctgtggcgg

SEQ ID NO: 402 - DNA, 30 bp; single-stranded, linear
tatgcaagcttaggccacggtgactgggta

SEQ ID NO: 403 - DNA, 30 bp; single-stranded, linear
tatgcaagcttaggaggccacggtgactgg

SEQ ID NO: 404 - DNA, 30 bp; single-stranded, linear
tatgcaagcttagttggaggccacggtgac

SEQ ID NO: 405 - DNA, 30 bp; single-stranded, linear
tatgcaagcttacaggttggaggccacggt

SEQ ID NO: 406 - DNA, 30 bp; single-stranded, linear
tatgcaagcttagtccaggttggaggccac

SEQ ID NO: 407 - DNA, 30 bp; single-stranded, linear
tatgcaagcttactcgtccaggttggaggc

SEQ ID NO: 408 - DNA, 30 bp; single-stranded, linear
tatgcaagcttactcctcgtccaggttgga

SEQ ID NO: 409 - DNA, 44 bp; single-stranded, linear
gactagccatggcngaygargarctgtgyggtggcctctggcgg

SEQ ID NO: 410 - DNA, 32 bp; single-stranded, linear
gactagtacgtactgcaggttggaggccacgg

SEQ ID NO: 411 - DNA, 36 bp; single-stranded, linear
gcaggttacgtattgaagcaggtagtcagacagctc

SEQ ID NO: 412 - DNA, 36 bp; single-stranded, linear
gcaggttacgtacacggtgactgggtaatcttgaag

SEQ ID NO: 413 - DNA, 35 bp; single-stranded, linear
gcaggttacgtaagtcttgagccgctccatccagc

SEQ ID NO: 414 - DNA, 36 bp; single-stranded, linear
gcaggttacgtagccagcgacagtcttgagccgctc

SEQ ID NO: 415 - DNA, 49 bp; single-stranded, linear
gtcaagccatggcnccrccragctgtctrcgcttcgttcagaccaactc

SEQ ID NO: 416 - DNA, 38 bp; single-stranded, linear
gcaggttacgtacggctgaaaggcacatttggtgacaa

SEQ ID NO: 417 - DNA, 30 bp; single-stranded, linear
gcaggttacgtaaagacagctggggggggg

SEQ ID NO: 418 - DNA, 34 bp; single-stranded, linear
gcaggttacgtactggacgaagcgaagacagctg

SEQ ID NO: 419 - DNA, 29 bp; single-stranded, linear
tatgctacgtaggccacggtgactgggta

SEQ ID NO: 420 - DNA, 29 bp; single-stranded, linear
tatgctacgtaggaggccacggtgactgg

SEQ ID NO: 421 - DNA, 29 bp; single-stranded, linear
tatgctacgtagttggaggccacggtgac

SEQ ID NO: 422 - DNA, 29 bp; single-stranded, linear
tatgctacgtacaggttggaggccacggt

SEQ ID NO: 423 - DNA, 29 bp; single-stranded, linear
tatgctacgtagtccaggttggaggccac

SEQ ID NO: 424 - DNA, 29 bp; single-stranded, linear
tatgctacgtactcgtccaggttggaggc

SEQ ID NO: 425 - DNA, 29 bp; single-stranded, linear
tatgctacgtactcctcgtccaggttgga

SEQ ID NO: 426 - DNA, 46 bp; single-stranded, linear
tcagttggatccggcggcggaagcggaggtggctctgggggaggta

SEQ ID NO: 427 - DNA, 48 bp; single-stranded, linear
tcagttggatcctccgccagaaccaccgcctgacccacctcctgaccc

SEQ ID NO: 428 - DNA, 60 bp; single-stranded, linear
gtctgaggcgccaccgcaccgaccgctggacaaccgcctctgacccaggactgctccttc

SEQ ID NO: 429 - DNA, 46 bp; single-stranded, linear
gtctgaggcgccaccgcaccgaccacccaggactgctccttccaac

SEQ ID NO: 430 - DNA, 60 bp; single-stranded, linear
gtctgaggcgccgagtggacgcgggctccacggtggcggcagggttgaggagtcgggctg

SEQ ID NO: 431 - DNA, 57 bp; single-stranded, linear; identical to SEQ ID NO: 393

SEQ ID NO: 432 - DNA, 57 bp; single-stranded, linear; identical to SEQ ID NO: 394

SEQ ID NO: 433 - DNA, 57 bp; single-stranded, linear; identical to SEQ ID NO: 395

SEQ ID NO: 434 - DNA, 57 bp; single-stranded, linear; identical to SEQ ID NO: 396

SEQ ID NO: 435 - DNA, 57 bp; single-stranded, linear; identical to SEQ ID NO: 397

SEQ ID NO: 436 - DNA, 57 bp; single-stranded, linear; identical to SEQ ID NO: 398

SEQ ID NO: 437 - DNA, 57 bp; single-stranded, linear; identical to SEQ ID NO: 399

SEQ ID NO: 438 - DNA, 57 bp; single-stranded, linear; identical to SEQ ID NO: 400

SEQ ID NO: 439 - DNA, 30 bp; single-stranded, linear; identical to SEQ ID NO: 402

SEQ ID NO: 440 - DNA, 30 bp; single-stranded, linear; identical to SEQ ID NO: 403

SEQ ID NO: 441 - DNA, 30 bp; single-stranded, linear; identical to SEQ ID NO: 404

SEQ ID NO: 442 - DNA, 30 bp; single-stranded, linear; identical to SEQ ID NO: 405

SEQ ID NO: 443 - DNA, 30 bp; single-stranded, linear
tatgcaagcttactgcaggttggaggccac

SEQ ID NO: 444 - DNA, 30 bp; single-stranded, linear
tatgcaagcttagtcctgcaggttggaggc

SEQ ID NO: 445 - DNA, 30 bp; single-stranded, linear
tatgcaagcttactcgtcctgcaggttgga

SEQ ID NO: 446 - DNA, 30 bp; single-stranded, linear
tatgcaagcttactcctcgtcctgcaggtt

SEQ ID NO: 447 - DNA, 47 bp; single-stranded, linear
gctacgtctagatctcctgacctcgacccaggactgctccttccaac

SEQ ID NO: 448 - DNA, 68 bp; single-stranded, linear
gctagttctagaccatcctggctgacacggtgaaacaccgtctctacgggctgacactgcagctccag

SEQ ID NO: 449 - DNA, 56 bp; single-stranded, linear
gtcagtactagtatgggtgtccgggctcttcggctcctgcaggttggaggccacgg

SEQ ID NO: 450 - DNA, 45 bp; single-stranded, linear
gtcagtactagtccgccatctccgacaccattaggccctgccagc

SEQ ID NO: 451 - DNA, 49 bp; single-stranded, linear
gtcagttccggagatttcggttctgcagagggctgcgcaaggtggcgta

SEQ ID NO: 452 - DNA, 64 bp; single-stranded, linear
gtcagttccggatactcataccagcccgccatccccgggttctaatctgcaagatgaagagctg

SEQ ID NO: 453 - DNA, 61 bp; single-stranded, linear
gtcagtactagtatgggtgtccgggctcttcggaaaggcacatttggtgacaaagtgtatc

SEQ ID NO: 454 - DNA, 48 bp; single-stranded, linear
gtcagtactagtccgccatctccgggtacaccattaggccctgccagc

SEQ ID NO: 455 - DNA, 63 bp; single-stranded, linear
gtcagttccggatactcataccagcccgccatccccgggtaaggcctttcagcccccccccag

SEQ ID NO: 456 - DNA, 33 bp; single-stranded, linear
gtcagaccatggccactcaggactcctcttttc

SEQ ID NO: 457 - DNA, 27 bp; single-stranded, linear
cactttgtcaccaaatctgcctttcag

SEQ ID NO: 458 - DNA, 27 bp; single-stranded, linear
ctgaaaggcagatttggtgacaaagtg

SEQ ID NO: 459 - DNA, 21 bp; single-stranded, linear
gcccccccccagctctcttcg

SEQ ID NO: 460 - DNA, 21 bp; single-stranded, linear
cgaagagagctgggggggggc

SEQ ID NO: 461 - DNA, 41 bp; single-stranded, linear
gtcagttacgtacagggttgaaggagtcgggctgagactgc

SEQ ID NO: 462 - DNA, 30 bp; single-stranded, linear
gtcagtccatggctactcaaggtgctatgc

SEQ ID NO: 463 - DNA, 31 bp; single-stranded, linear
gtagcatacgtagggctgcagggcaggggcc

SEQ ID NO: 464 - protein, 166 aa
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 465 - protein, 165 aa
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAA

SEQ ID NO: 466 - protein, 139 aa
TQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 467 - protein, 155 aa
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREF

SEQ ID NO: 468 - protein, 309 aa
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQGRTTAHKDPNAIFLSFQHLLRGKVRFLMLVGGSTLCVR

SEQ ID NO: 469 - protein, 312 aa
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVR

SEQ ID NO: 470 - protein, 313 aa
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVR

SEQ ID NO: 471 - protein, 316 aa [sequence omitted]

SEQ ID NO: 472 - protein, 302 aa [sequence omitted]

SEQ ID NO: 473 - protein, 317 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPSGGSGGSQSFLLKSLEQVRKIQGDGAALQEKLCAT

SEQ ID NO: 474 - protein, 302 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMAPELGPTLDTLQLDVADFATTIWQQMEELGMAPALQPTQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGIS

SEQ ID NO: 475 - protein, 317 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAPELGPTLDTLQLDVADFATTIWQQMEELGMAPALQPTQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGIS

SEQ ID NO: 476 - protein, 302 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMAMAPALQPTQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELG

SEQ ID NO: 477 - protein, 317 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAMAPALQPTQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELG

SEQ ID NO: 478 - protein, 302 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 479 - protein, 317 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 480 - protein, 302 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFA

SEQ ID NO: 481 - protein, 317 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFA

SEQ ID NO: 482 - protein, 305 aa [sequence omitted]

SEQ ID NO: 483 - protein, 320 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPTPLGPASSLPQSFLLKSLEQVRKIQGDGAALQEKLCAT

SEQ ID NO: 484 - protein, 305 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMAPELGPTLDTLQLDVADFATTIWQQMEELGMAPALQPTQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGIS

SEQ ID NO: 485 - protein, 320 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAPELGPTLDTLQLDVADFATTIWQQMEELGMAPALQPTQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGIS

SEQ ID NO: 486 - protein, 305 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMAMAPALQPTQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELG

SEQ ID NO: 487 - protein, 320 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAMAPALQPTQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELG

SEQ ID NO: 488 - protein, 305 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMATQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 489 - protein, 320 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMATQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 490 - protein, 305 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGGGSGGGSNMASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFA

SEQ ID NO: 491 - protein, 320 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFA

SEQ ID NO: 492 - protein, 321 aa
LDPNNLNDEDVSILMDRNLRLPNLESFVRAVKNLENASGIEAILRNLQPCLPSATAAPSRHPIIIKAGDWQEFREKLTFYLVTLEQAQEQQGGGSNCSIMIDEIIHHLKRPPAPLYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 493 - protein, 321 aa
NASGIEAILRNLQPCLPSATAAPSRHPIIIKAGDWQEFREKLTFYLVTLEQAQEQQGGGSNCSIMIDEIIHHLKRPPAPLLDPNNLNDEDVSILMDRNLRLPNLESFVRAVKNLEYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 494 - protein, 321 aa
APSRHPIIIKAGDWQEFREKLTFYLVTLEQAQEQQGGGSNCSIMIDEIIHHLKRPPAPLLDPNNLNDEDVSILMDRNLRLPNLESFVRAVKNLENASGIEAILRNLQPCLPSATAYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 495 - protein, 321 aa
AGDWQEFREKLTFYLVTLEQAQEQQGGGSNCSIMIDEIIHHLKRPPAPLLDPNNLNDEDVSILMDRNLRLPNLESFVRAVKNLENASGIEAILRNLQPCLPSATAAPSRHPIIIKYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 496 - protein, 329 aa
LDPNNLNDEDVSILMDRNLRLPNLESFVRAVKNLENASGIEAILRNLQPCLPSATAAPSRHPIIIKAGDWQEFREKLTFYLVTLEQAQEQQGGGSGGGSGGGSNCSIMIDEIIHHLKRPPAPLYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 497 - protein, 329 aa
NASGIEAILRNLQPCLPSATAAPSRHPIIIKAGDWQEFREKLTFYLVTLEQAQEQQGGGSGGGSGGGSNCSIMIDEIIHHLKRPPAPLLDPNNLNDEDVSILMDRNLRLPNLESFVRAVKNLEYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 498 - protein, 329 aa
APSRHPIIIKAGDWQEFREKLTFYLVTLEQAQEQQGGGSGGGSGGGSNCSIMIDEIIHHLKRPPAPLLDPNNLNDEDVSILMDRNLRLPNLESFVRAVKNLENASGIEAILRNLQPCLPSATAYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 499 - protein, 329 aa
AGDWQEFREKLTFYLVTLEQAQEQQGGGSGGGSGGGSNCSIMIDEIIHHLKRPPAPLLDPNNLNDEDVSILMDRNLRLPNLESFVRAVKNLENASGIEAILRNLQPCLPSATAAPSRHPIIIKYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 500 - protein, 329 aa
MANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPGGGSDMATPLGPASSLPQSFLLKSLEQVRKIQGDGAALQEKLCAT

SEQ ID NO: 501 - protein, 329 aa [sequence omitted]

SEQ ID NO: 502 - protein, 329 aa
MANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMASAFQRRAGGVLVASHLQSFLEVSYRVLRHLAQPGGGSDMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFA

SEQ ID NO: 503 - protein, 329 aa
MANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAMAPALQPTQGAMPAFASAFQRRAGGVLVASHLQSFLEVSYRVLRHLAQPGGGSDMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELG

SEQ ID NO: 504 - protein, 329 aa [sequence omitted]

SEQ ID NO: 505 - protein, 319 aa
MANCSNMIDEIITHLKQPPLPLLDFNNLNGEDQDILMDNNLRRPNLEAFNRAVKSLQNASAIESILKNLLPCLPLATAAPTRHPIHIKDGDWNEFRRKLTFYLKTLENAQAQQYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 506 - protein, 322 aa
MANCSNMIDEIITHLKQPPLPLLDFNNLNGEDQDILMENNLRRPNLEAFNRAVKSLQNASAIESILKNLLPCLPLATAAPTRHPIIIRDGDWNEFRRKLTFYLKTLENAQAQQYVEGGGGSPGEPSGPISTINPSPPSKESHKSPNMATQGAMPAFASAFQRRAGGVLVASHLQSFLEVSYRVLRHLAQPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 507 - protein, 319 aa
MANCSNMIDEIITHLKQPPLPLLDFNNLNGEDQDILMENNLRRPNLEAFNRAVKSLQNASAIESILKNLLPCLPLATAAPTRHPIIIRDGDWNEFRRKLTFYLKTLENAQAQQYVEGGGGSPGEPSGPISTINPSPPSKESHKSPNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 508 - protein, 322 aa [sequence omitted]

SEQ ID NO: 509 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCP

SEQ ID NO: 510 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHP

SEQ ID NO: 511 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTP

SEQ ID NO: 512 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLP

SEQ ID NO: 513 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLPAV

SEQ ID NO: 514 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLPAVDFSL

SEQ ID NO: 515 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGPTCLSSLLGQLSGQVRLLLGALQSLLGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQL

SEQ ID NO: 516 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGTQLPPQGRTTAHKDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLL

SEQ ID NO: 517 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGRTTAHKDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQ

SEQ ID NO: 518 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAHKDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTT

SEQ ID NO: 519 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHK

SEQ ID NO: 520 - protein, 306 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPN

SEQ ID NO: 521 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCP

SEQ ID NO: 522 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHP

SEQ ID NO: 523 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHPLPTP

SEQ ID NO: 524 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHPLPTPVLLP

SEQ ID NO: 525 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHPLPTPVLLPAV

SEQ ID NO: 526 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHPLPTPVLLPAVDFSL

SEQ ID NO: 527 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGPTCLSSLLGQLSGQVRLLLGALQSLLGTQLPPQGRTTAHKDPNAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQL

SEQ ID NO: 528 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGTQLPPQGRTTAHKDPNAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLL

SEQ ID NO: 529 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGRTTAHKDPNAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQ

SEQ ID NO: 530 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAHKDPNAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTT

SEQ ID NO: 531 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDPNAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHK

SEQ ID NO: 532 - protein, 305 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAIFLSFQHLLRGKVRFLMLVGGSTLCVREFGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPN

SEQ ID NO: 533 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNGGNMASPAPPACDLRVLSKLLRDSHVLHSRLSQCP

SEQ ID NO: 534 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNGGNMASPAPPACDLRVLSKLLRDSHVLHSRLSQCPEVHP

SEQ ID NO: 535 - protein, 309 aa [sequence omitted]

SEQ ID NO: 536 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNGGNMASPAPPACDLRVLSKLLRDSHVLHSRLSQCPEVHPLPTPVLLP

SEQ ID NO: 537 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNGGNMASPAPPACDLRVLSKLLRDSHVLHSRLSQCPEVHPLPTPVLLPAV

SEQ ID NO: 538 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVREFGGNGGNMASPAPPACDLRVLSKLLRDSHVLHSRLSQCPEVHPLPTPVLLPAVDFSL

SEQ ID NO: 539 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGPTCLSSLLGQLSGQVRLLLGALQSLLGTQLPPQGRTTAHKDPNAIFLSFQHLLRGKVRFLMLVGGSTLCVREFGGNGGNMASPAPPACDLRVLSKLLRDSHVLHSRLSQCPEVHPLPTPVLLPAVDFSLGEWKTQMEETKAQDILGAVTLLLEGVMAARGQL

SEQ ID NO: 540 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGTQLPPQGRTTAHKDPNAIFLSFQHLLRGKVRFLMLVGGSTLCVREFGGNGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLL

SEQ ID NO: 541 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMGRTTAHKDPNAIFLSFQHLLRGKVRFLMLVGGSTLCVREFGGNGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQ

SEQ ID NO: 542 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAHKDPNAIFLSFQHLLRGKVRFLMLVGGSTLCVREFGGNGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTT

SEQ ID NO: 543 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDPNAIFLSFQHLLRGKVRFLMLVGGSTLCVREFGGNGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHK

SEQ ID NO: 544 - protein, 309 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAIFLSFQHLLRGKVRFLMLVGGSTLCVREFGGNGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPN

SEQ ID NO: 545 - protein, 302 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMDPNAIFLSFQHLLRGKVRFLMLVGGSTLCVREFGGNMASPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQGRTTAHK

SEQ ID NO: 546 - protein, 153 aa
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVR

SEQ ID NO: 547 - protein, 149 aa
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQGRTTAHKDPNAIFLSFQHLLRGKVRFLMLVGGSTLCVR

SEQ ID NO: 548 - protein, 153 aa; identical to SEQ ID NO: 546

SEQ ID NO: 549 - protein, 135 aa
ATQDCSFQHSPISSDFAVKIRELSDYLLQDYPVTVASNLQDEELCGALWRLVLAQRWMERLKTVAGSKMQGLLERVNTEIHFVTKCAFQPPPSCLRFVQTNISRLLQETSEQLVALKPWITRQNFSRCLELQCQP

SEQ ID NO: 550 - protein, 140 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 551 - protein, 122 aa
ATQDCSFQHSPISSDFAVKIRELSDYLLQDYPVTVASNLQDEELCGGLWRLVLAQRWMERLKTVAGSKMQGLLERVNTEIHFVTKCAFQETSEQLVALKPWITRQNFSRCLELQCQPDSSTL

SEQ ID NO: 552 - protein, 135 aa
GTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQP

SEQ ID NO: 553 - protein, 140 aa
GTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 554 - protein, 135 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQP

SEQ ID NO: 555 - protein, 140 aa; identical to SEQ ID NO: 550

SEQ ID NO: 556 - protein, 155 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLSGGNGSGGNGSGGNGTQDCSFQHSPISSDFAVKIRELSDYLLQDYPVTVASNLQ

SEQ ID NO: 557 - protein, 150 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLSGGNGSGGNGTQDCSFQHSPISSDFAVKIRELSDYLLQDYPVTVASNLQ

SEQ ID NO: 558 - protein, 145 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLSGGNGTQDCSFQHSPISSDFAVKIRELSDYLLQDYPVTVASNLQ

SEQ ID NO: 559 - protein, 155 aa
ASKMQGLLERVNTEIHFVTKCAFQPPPSCLRFVQTNISRLLQETSEQLVALKPWITRQNFSRCLELQCQPDSSTLSGGNGSGGNGSGGNGTQDCSFQHSPISSDFAVKIRELSDYLLQDYPVTVASNLQDEELCGGLWRLVLAQRWMERLKTVAG

SEQ ID NO: 560 - protein, 150 aa
ASKMQGLLERVNTEIHFVTKCAFQPPPSCLRFVQTNISRLLQETSEQLVALKPWITRQNFSRCLELQCQPDSSTLSGGNGSGGNGTQDCSFQHSPISSDFAVKIRELSDYLLQDYPVTVASNLQDEELCGGLWRLVLAQRWMERLKTVAG

SEQ ID NO: 561 - protein, 145 aa
ASKMQGLLERVNTEIHFVTKCAFQPPPSCLRFVQTNISRLLQETSEQLVALKPWITRQNFSRCLELQCQPDSSTLSGGNGTQDCSFQHSPISSDFAVKIRELSDYLLQDYPVTVASNLQDEELCGGLWRLVLAQRWMERLKTVAG

SEQ ID NO: 562 - protein, 155 aa
APPSCLRFVQTNISRLLQETSEQLVALKPWITRQNFSRCLELQCQPDSSTLSGGNGSGGNGSGGNGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 563 - protein, 150 aa
APPSCLRFVQTNISRLLQETSEQLVALKPWITRQNFSRCLELQCQPDSSTLSGGNGSGGNGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 564 - protein, 145 aa
APPSCLRFVQTNISRLLQETSEQLVALKPWITRQNFSRCLELQCQPDSSTLSGGNGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 565 - protein, 155 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLSGGSGSGGSGSGGSGTQDCSFQHSPISSDFAVKIRELSDYLLQDYPVTVASNLQ

SEQ ID NO: 566 - protein, 150 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLSGGSGSGGSGTQDCSFQHSPISSDFAVKIRELSDYLLQDYPVTVASNLQ

SEQ ID NO: 567 - protein, 145 aa
MATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGS

SEQ ID NO: 568 - protein, 143 aa
GSGGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 569 - protein, 149 aa
MATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGS

SEQ ID NO: 570 - protein, 144 aa
GSGGGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 571 - protein, 153 aa
MATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGS

SEQ ID NO: 572 - protein, 150 aa
GSGGGSGGGSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 573 - protein, 146 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGTQDCSFQHSPISSDFAVKIRELSDYLLQDYPVTVASNLQ

SEQ ID NO: 574 - protein, 147 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGTQDCSFQHSPISSDFAVKIRELSDYLLQDYPVTVASNLQ

SEQ ID NO: 575 - protein, 150 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGTQDCSFQHSPISSDFAVKIRELSDYLLQDYPVTVASNLQ

SEQ ID NO: 576 - protein, 153 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGTQDCSFQHSPISSDFAVKIRELSDYLLQDYPVTVASNLQ

SEQ ID NO: 577 - protein, 155 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQ

SEQ ID NO: 578 - protein, 161 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQ

SEQ ID NO: 579 - protein, 281 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMATQDCSFQHSPISSDFAVKIRELSDYLLQDYPVTVASNLQDEELCGALWRLVLAQRWMERLKTVAGSKMQGLLERVNTEIHFVTKCAFQPPPSCLRFVQTNISRLLQETSEQLVALKPWITRQNFSRCLELQCQP

SEQ ID NO: 580 - protein, 286 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMATQDCSFQHSPISSDFAVKIRELSDYLLQDYPVTVASNLQDEELCGALWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 581 - protein, 296 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLSGGNGSGGNGTQDCSFQHSPISSDFAVKIRELSDYLLQDYPVTVASNLQ

SEQ ID NO: 582 - protein, 296 aa; identical to SEQ ID NO: 581

SEQ ID NO: 583 - protein, 291 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMASKMQGLLERVNTEIHFVTKCAFQPPPSCLRFVQTNISRLLQETSEQLVALKPWITRQNFSRCLELQCQPDSSTLSGGNGTQDCSFQHSPISSDFAVKIRELSDYLLQDYPVTVASNLQDEELCGGLWRLVLAQRWMERLKTVAG

SEQ ID NO: 584 - protein, 296 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMASKMQGLLERVNTEIHFVTKCAFQPPPSCLRFVQTNISRLLQETSEQLVALKPWITRQNFSRCLELQCQPDSSTLSGGNGSGGNGTQDCSFQHSPISSDFAVKIRELSDYLLQDYPVTVASNLQDEELCGGLWRLVLAQRWMERLKTVAG

SEQ ID NO: 585 - protein, 301 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLSGGNGSGGNGSGGNGTQDCSFQHSPISSDFAVKIRELSDYLLQDYPVTVASNLQ

SEQ ID NO: 586 - protein, 291 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAPPSCLRFVQTNISRLLQETSEQLVALKPWITRQNFSRCLELQCQPDSSTLSGGNGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 587 - protein, 296 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAPPSCLRFVQTNISRLLQETSEQLVALKPWITRQNFSRCLELQCQPDSSTLSGGNGSGGNGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 588 - protein, 301 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMAPPSCLRFVQTNISRLLQETSEQLVALKPWITRQNFSRCLELQCQPDSSTLSGGNGSGGNGSGGNGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 589 - protein, 281 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQP

SEQ ID NO: 590 - protein, 286 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 591 - protein, 296 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLSGGNGSGGNGTQDCSFQHSPISSDFAVKIRELSDYLLQDYPVTVASNLQ

SEQ ID NO: 592 - protein, 301 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLSGGNGSGGNGSGGNGTQDCSFQHSPISSDFAVKIRELSDYLLQDYPVTVASNLQ

SEQ ID NO: 593 - protein, 291 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMASKMQGLLERVNTEIHFVTKCAFQPPPSCLRFVQTNISRLLQETSEQLVALKPWITRQNFSRCLELQCQPDSSTLSGGNGTQDCSFQHSPISSDFAVKIRELSDYLLQDYPVTVASNLQDEELCGGLWRLVLAQRWMERLKTVAG

SEQ ID NO: 594 - protein, 296 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMASKMQGLLERVNTEIHFVTKCAFQPPPSCLRFVQTNISRLLQETSEQLVALKPWITRQNFSRCLELQCQPDSSTLSGGNGSGGNGTQDCSFQHSPISSDFAVKIRELSDYLLQDYPVTVASNLQDEELCGGLWRLVLAQRWMERLKTVAG

SEQ ID NO: 595 - protein, 301 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMASKMQGLLERVNTEIHFVTKCAFQPPPSCLRFVQTNISRLLQETSEQLVALKPWITRQNFSRCLELQCQPDSSTLSGGNGSGGNGSGGNGTQDCSFQHSPISSDFAVKIRELSDYLLQDYPVTVASNLQDEELCGGLWRLVLAQRWMERLKTVAG

SEQ ID NO: 596 - protein, 291 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAPPSCLRFVQTNISRLLQETSEQLVALKPWITRQNFSRCLELQCQPDSSTLSGGNGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 597 - protein, 296 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAPPSCLRFVQTNISRLLQETSEQLVALKPWITRQNFSRCLELQCQPDSSTLSGGNGSGGNGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 598 - protein, 301 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAPPSCLRFVQTNISRLLQETSEQLVALKPWITRQNFSRCLELQCQPDSSTLSGGNGSGGNGSGGNGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 599 - protein, 296 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLSGGSGSGGSGTQDCSFQHSPISSDFAVKIRELSDYLLQDYPVTVASNLQ

SEQ ID NO: 600 - protein, 301 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLSGGSGSGGSGSGGSGTQDCSFQHSPISSDFAVKIRELSDYLLQDYPVTVASNLQ

SEQ ID NO: 601 - protein, 281 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 602 - protein, 286 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 603 - protein, 268 aa
ANCSIMIDEIIHHLKRPPNPLLDPNNLNSEDMDILMERNLRTPNLLAFVRAVKHLENASGIEAILRNLQPCLPSATAAPSPHPIIIKAGDWQEFREKLTFYLVTLEQAQEQQYVEGGGGSPGEPSGPISTINPSPPSKESHKSPNMATQDCSFQHSPISSDFAVKIRELSDYLLQDYPVTVASNLQDEELCGGLWRLVLAQRWMERLKTVAGSKMQGLLERVNTEIHFVTKCAFQETSEQLVALKPWITRQNFSRCLELQCQPDSSTL

SEQ ID NO: 604 - protein, 292 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGTQDCSFQHSPISSDFAVKIRELSDYLLQDYPVTVASNLQ

SEQ ID NO: 605 - protein, 293 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGTQDCSFQHSPISSDFAVKIRELSDYLLQDYPVTVASNLQ

SEQ ID NO: 606 - protein, 296 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGTQDCSFQHSPISSDFAVKIRELSDYLLQDYPVTVASNLQ

SEQ ID NO: 607 - protein, 299 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGTQDCSFQHSPISSDFAVKIRELSDYLLQDYPVTVASNLQ

SEQ ID NO: 608 - protein, 301 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQ

SEQ ID NO: 609 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQ

SEQ ID NO: 610 - protein, 292 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMASKMQGLLERVNTEIHFVTKCAFQPPPSCLRFVQTNISRLLQETSEQLVALKPWITRQNFSRCLELQCQPDSSTLGGGSGGTQDCSFQHSPISSDFAVKIRELSDYLLQDYPVTVASNLQDEELCGGLWRLVLAQRWMERLKTVAG

SEQ ID NO: 611 - protein, 293 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMASKMQGLLERVNTEIHFVTKCAFQPPPSCLRFVQTNISRLLQETSEQLVALKPWITRQNFSRCLELQCQPDSSTLGGGSGGGTQDCSFQHSPISSDFAVKIRELSDYLLQDYPVTVASNLQDEELCGGLWRLVLAQRWMERLKTVAG

SEQ ID NO: 612 - protein, 296 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMASKMQGLLERVNTEIHFVTKCAFQPPPSCLRFVQTNISRLLQETSEQLVALKPWITRQNFSRCLELQCQPDSSTLGGGSGGGSGGTQDCSFQHSPISSDFAVKIRELSDYLLQDYPVTVASNLQDEELCGGLWRLVLAQRWMERLKTVAG

SEQ ID NO: 613 - protein, 299 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMASKMQGLLERVNTEIHFVTKCAFQPPPSCLRFVQTNISRLLQETSEQLVALKPWITRQNFSRCLELQCQPDSSTLGGGSGGGSGGGSGTQDCSFQHSPISSDFAVKIRELSDYLLQDYPVTVASNLQDEELCGGLWRLVLAQRWMERLKTVAG

SEQ ID NO: 614 - protein, 301 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMASKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAG

SEQ ID NO: 615 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMASKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDEELCGGLWRLVLAQRWMERLKTVAG

SEQ ID NO: 616 - protein, 292 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAPPSCLRFVQTNISRLLQETSEQLVALKPWITRQNFSRCLELQCQPDSSTLGGGSGGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 617 - protein, 293 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAPPSCLRFVQTNISRLLQETSEQLVALKPWITRQNFSRCLELQCQPDSSTLGGGSGGGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 618 - protein, 296 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAPPSCLRFVQTNISRLLQETSEQLVALKPWITRQNFSRCLELQCQPDSSTLGGGSGGGSGGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 619 - protein, 299 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAPPSCLRFVQTNISRLLQETSEQLVALKPWITRQNFSRCLELQCQPDSSTLGGGSGGGSGGGSGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 620 - protein, 301 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 621 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 622 - protein, 296 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGTQDCSFQHSPISSDFAVKIRELSDYLLQ

SEQ ID NO: 623 - protein, 301 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQ

SEQ ID NO: 624 - protein, 296 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGTQDCSFQHSPISSDFAVKIRELSDYLLQDYPVTV

SEQ ID NO: 625 - protein, 301 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTV

SEQ ID NO: 626 - protein, 296 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAVAGSKMQGLLERVNTEIHFVTKCAFQPPPSCLRFVQTNISRLLQETSEQLVALKPWITRQNFSRCLELQCQPDSSTLGGGSGGGSGGTQDCSFQHSPISSDFAVKIRELSDYLLQDYPVTVASNLQDEELCGGLWRLVLAQRWMERLKT

SEQ ID NO: 627 - protein, 301 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKT

SEQ ID NO: 628 - protein, 296 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMARFVQTNISRLLQETSEQLVALKPWITRQNFSRCLELQCQPDSSTLGGGSGGGSGGTQDCSFQHSPISSDFAVKIRELSDYLLQDYPVTVASNLQDEELCGGLWRLVLAQRWMERLKTVAGSKMQGLLERVNTEIHFVTKCAFQPPPSCL

SEQ ID NO: 629 - protein, 301 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMARFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGSKMQGLLERVNTEIHFVTKCAFQPPPSCL

SEQ ID NO: 630 - protein, 296 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGSSPGEPSGPISTINPSPPSKESHKSPNMATNISRLLQETSEQLVALKPWITRQNFSRCLELQCQPDSSTLGGGSGGGSGGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQ

SEQ ID NO: 631 - protein, 301 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMATNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQ

SEQ ID NO: 632 - protein, 292 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGTQDCSFQHSPISSDFAVKIRELSDYLLQ

SEQ ID NO: 633 - protein, 293 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGTQDCSFQHSPISSDFAVKIRELSDYLLQ

SEQ ID NO: 634 - protein, 299 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGTQDCSFQHSPISSDFAVKIRELSDYLLQ

SEQ ID NO: 635 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDEELCGGLWRLVLAQRWMERLKT

SEQ ID NO: 636 - protein, 292 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGTQDCSFQHSPISSDFAVKIRELSDYLLQDYPVTV

SEQ ID NO: 637 - protein, 293 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGTQDCSFQHSPISSDFAVKIRELSDYLLQDYPVTV

SEQ ID NO: 638 - protein, 299 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGTQDCSFQHSPISSDFAVKIRELSDYLLQDYPVTV

SEQ ID NO: 639 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTV

SEQ ID NO: 640 - protein, 292 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAVAGSKMQGLLERVNTEIHFVTKCAFQPPPSCLRFVQTNISRLLQETSEQLVALKPWITRQNFSRCLELQCQPDSSTLGGGSGGTQDCSFQHSPISSDFAVKIRELSDYLLQDYPVTVASNLQDEELCGGLWRLVLAQRWMERLKT

SEQ ID NO: 641 - protein, 293 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAVAGSKMQGLLERVNTEIHFVTKCAFQPPPSCLRFVQTNISRLLQETSEQLVALKPWITRQNFSRCLELQCQPDSSTLGGGSGGGTQDCSFQHSPISSDFAVKIRELSDYLLQDYPVTVASNLQDEELCGGLWRLVLAQRWMERLKT

SEQ ID NO: 642 - protein, 299 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAVAGSKMQGLLERVNTEIHFVTKCAFQPPPSCLRFVQTNISRLLQETSEQLVALKPWITRQNFSRCLELQCQPDSSTLGGGSGGGSGGGSGTQDCSFQHSPISSDFAVKIRELSDYLLQDYPVTVASNLQDEELCGGLWRLVLAQRWMERLKT

SEQ ID NO: 643 - protein, 307 aa; identical to SEQ ID NO: 635

SEQ ID NO: 644 - protein, 292 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMARFVQTNISRLLQETSEQLVALKPWITRQNFSRCLELQCQPDSSTLGGGSGGTQDCSFQHSPISSDFAVKIRELSDYLLQDYPVTVASNLQDEELCGGLWRLVLAQRWMERLKTVAGSKMQGLLERVNTEIHFVTKCAFQPPPSCL

SEQ ID NO: 645 - protein, 293 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMARFVQTNISRLLQETSEQLVALKPWITRQNFSRCLELQCQPDSSTLGGGSGGGTQDCSFQHSPISSDFAVKIRELSDYLLQDYPVTVASNLQDEELCGGLWRLVLAQRWMERLKTVAGSKMQGLLERVNTEIHFVTKCAFQPPPSCL

SEQ ID NO: 646 - protein, 299 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMARFVQTNISRLLQETSEQLVALKPWITRQNFSRCLELQCQPDSSTLGGGSGGGSGGGSGTQDCSFQHSPISSDFAVKIRELSDYLLQDYPVTVASNLQDEELCGGLWRLVLAQRWMERLKTVAGSKMQGLLERVNTEIHFVTKCAFQPPPSCL

SEQ ID NO: 647 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMARFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDEELCGGLWRLVLAQRWMERLKTVAGSKMQGLLERVNTEIHFVTKCAFQPPPSCL

SEQ ID NO: 648 - protein, 292 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGSSPGEPSGPISTINPSPPSKESHKSPNMATNISRLLQETSEQLVALKPWITRQNFSRCLELQCQPDSSTLGGGSGGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQ

SEQ ID NO: 649 - protein, 293 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGSSPGEPSGPISTINPSPPSKESHKSPNMATNISRLLQETSEQLVALKPWITRQNFSRCLELQCQPDSSTLGGGSGGGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQ

SEQ ID NO: 650 - protein, 299 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGSSPGEPSGPISTINPSPPSKESHKSPNMATNISRLLQETSEQLVALKPWITRQNFSRCLELQCQPDSSTLGGGSGGGSGGGSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQ

SEQ ID NO: 651 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMATNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQ

SEQ ID NO: 652 - protein, 749 aa [sequence omitted]

SEQ ID NO: 653 - protein, 349 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 654 - protein, 314 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLYVEGGGGSPGEPSGPISTINPSPPSKESHKSPNMATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 655 - protein, 349 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 656 - protein, 523 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLYVEGGGGSPGEPSGPISTINPSPPSKESHKSPNMATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 657 - protein, 460 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLYVEGGGGSPGEPSGPISTINPSPPSKESHKSPNMATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 658 - protein, 523 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLYVEGGGGSPGEPSGPISTINPSPPSKESHKSPNMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 659 - protein, 334 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLYVEGGGGSPGGGSGGGSNMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 660 - protein, 296 aa; identical to SEQ ID NO: 622

SEQ ID NO: 661 - protein, 301 aa; identical to SEQ ID NO: 623

SEQ ID NO: 662 - protein, 296 aa; identical to SEQ ID NO: 624

SEQ ID NO: 663 - protein, 301 aa; identical to SEQ ID NO: 625

SEQ ID NO: 664 - protein, 296 aa; identical to SEQ ID NO: 626

SEQ ID NO: 665 - protein, 301 aa; identical to SEQ ID NO: 627

SEQ ID NO: 666 - protein, 296 aa; identical to SEQ ID NO: 628

SEQ ID NO: 667 - protein, 301 aa; identical to SEQ ID NO: 629

SEQ ID NO: 668 - protein, 296 aa; identical to SEQ ID NO: 630

SEQ ID NO: 669 - protein, 301 aa; identical to SEQ ID NO: 631

SEQ ID NO: 670 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVA

SEQ ID NO: 671 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMANLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVAS

SEQ ID NO: 672 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMALQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASN

SEQ ID NO: 673 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNL

SEQ ID NO: 674 - protein, 305 aa
ANCSIMIDEIIHHLKRPPNPLLDPNNLNSEDMDILRNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQD

SEQ ID NO: 675 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDE

SEQ ID NO: 676 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMALCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDEE

SEQ ID NO: 677 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDSAVKIRELSDYLLQDYPVTVA

SEQ ID NO: 678 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMAQDEELCGGLWRLVLAQRWMERLKTVAGSKMQGLLERVNTEIHFVTKCAFQPPPSCLRFVQTNISRLLRETSEQPVALKPWITRQNFSRCLELQCQPDSSTLGGGSGGGSGGGSGGGSGGGSGTQDCSFQHSPISSDFAVKIRELSDYLLQDYPVTVASNL

SEQ ID NO: 679 - protein, 307 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMALCGGLWRLVLAQRWMERLKTVAGSKMQGLLERVNTEIHFVTKCAFQPPPSCLRFVQTNISRLLQETSEQLVALKPWITRQNFSRCLELQCRPDSSTLGGGSGGGSGGGSGGGSGGGSGTQDCSFQHSPISSDFAVKIRELSDYLLQDYPVTVASNLQDEE

SEQ ID NO: 680 - protein, 302 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 681 - protein, 296 aa
ADEELCGGLWRLVLAQRWMERLKTVAGSKMQGLLERVNTEIHFVTKCAFQPPPSCLRFVQTNISRLLQETSEQLVALRPWITRQNFSRCLELQCQPDSSTLGGGSGGGSGGTQDCSFQHSPISSDFAVKIRELSDYLLQDYPVTVASNLQYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 682 - protein, 301 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 683 - protein, 307 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 684 - protein, 301 aa
ADEELCGGLWRLVLAQRWMERLKTVAGSKMQGLLERVNTEIHFVTKCAFQPPPSCLRLVQTNISRLLQETSEQLVALKPWITRQNFSRCLELQCQPDSSTLGGGSGGGSGGGSGGGTQDCSFQHSPISSDFAVKIRELSDYLLQDYPVTVASNLQYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 685 - protein, 307 aa
ADEELCGGLWRLVLAQRWMGRLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 686 - protein, 302 aa
MADYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 687 - protein, 301 aa
AASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 688 - protein, 301 aa
AVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 689 - protein, 301 aa
ASKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 690 - protein, 301 aa
APPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGSKMQGLLERVNTEIHFVTKCAFQPYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 691 - protein, 301 aa
ATNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 692 - protein, 301 aa
ARFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGSKMQGLLERVNTEIHFVTKCAFQPPPSCFYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 693 - protein, 307 aa
ASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVAYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 694 - protein, 307 aa
ANLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 695 - protein, 307 aa
ALQDEELCGGLWRLVLAQRLMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 696 - protein, 307 aa
AQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 697 - protein, 307 aa
AEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 698 - protein, 307 aa
ALCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDEEYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 699 - protein, 307 aa; identical to SEQ ID NO: 698

SEQ ID NO: 700 - protein, 307 aa
ALCGGLWRLVLAQRWMERLKTVAGSKMQGLLERVNTEIHFVTKCAFQPPPSCLRFVQTNISRLLQETSEQLVALKPWITRQNFSRCLELQCRPDSSTLGGGSGGGSGGGSGGGSGGGSGTQDCSFQHSPISSDFAVKIRELSDYLLQDYPVTVASNLQDEEYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 701 - protein, 301 aa; identical to SEQ ID NO: 689

SEQ ID NO: 702 - protein, 315 aa
AQDDELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGGGSGGGSGTQDCSFQHSPISSDFAVKIRELSDYLLQDYPVTVASNLYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 703 - protein, 301 aa
AQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLGATAPTTQDCSFQHSPISSDFAVKIRELSDYLLQDYPVTVASNLYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 704 - protein, 307 aa
AQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLGATAPTAGQPPLTQDCSFQHSPISSDFAVKIRELSDYLLQDYPVTVASNLYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 705 - protein, 370 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQ

SEQ ID NO: 706 - protein, 370 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMANLQDEELCGGLWRLVLAQRWMERLKTVAGSKMQGLLERVNTEIHFVTKCAFQPPPSCLRFVQINISRLLQETSEQLVALKPWITRQNFSRCLELQCQPDSSTLGGGSGGGSGGGSGGGSGGGSGTQDCSFQHSPISSDFAVKIRELSDYLLQDYPVTVAS

SEQ ID NO: 707 - protein, 370 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMAPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 708 - protein, 370 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMALQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASN

SEQ ID NO: 709 - protein, 370 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMAQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNL

SEQ ID NO: 710 - protein, 370 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMAEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQD

SEQ ID NO: 711 - protein, 370 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMAELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDE

SEQ ID NO: 712 - protein, 370 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMALCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDEE

SEQ ID NO: 713 - protein, 364 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLGATAPTTQDCSFQHSPISSDFAVKIRELSDYLLQDYPVTVASNLQ

SEQ ID NO: 714 - protein, 378 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGGGSGGGSGTQDCSFQHSPISSDFAVKIRELSDYLLQDYPVTVASNLQ

SEQ ID NO: 715 - protein, 370 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLGATAPTAGQPPLTQDCSFQHSPISSDFAVKIRELSDYLLQDYPVTVASNLQ

SEQ ID NO: 716 - protein, 155 aa
ADYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQ

SEQ ID NO: 717 - protein, 155 aa
AASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTV

SEQ ID NO: 718 - protein, 155 aa
AVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKT

SEQ ID NO: 719 - protein, 155 aa
ASKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAG

SEQ ID NO: 720 - protein, 155 aa
APPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGSKMQGLLERVNTEIHFVTKCAFQP

SEQ ID NO: 721 - protein, 155 aa
ARFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGSKMQGLLERVNTEIHFVTKCAFQPPPSCL

SEQ ID NO: 722 - protein, 155 aa
ATNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQ

SEQ ID NO: 723 - protein, 370 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGEPSGPISTINPSPPSKESHKSPNMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 724 - protein, 370 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 725 - protein, 354 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLGATAPTAGQPPLTQDCSFQHSPISSDFAVKIRELSDYLLQDYPVTVASNLYVEGGGGSPGGGSGGGSNMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 726 - protein, 363 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGGGSGGGSGTQDCSFQHSPISSDFAVKIRELSDYLLQDYPVTVASNLQYVEGGGGSPGGGSGGGSNMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 727 - protein, 348 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLGATAPTTQDCSFQHSPISSDFAVKIRELSDYLLQDYPVTVASNLYVEGGGGSPGGGSGGGSNMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 728 - protein, 359 aa
ADEELCGGLWRLVLAQRWMERLKTVAGSKMQGLLERVNTEIHFVTKCAFQPPPSCLRFVQTNISRLLQETSEQLVALRPWITRQNFSRCLELQCQPDSSTLGGGSGGGSGGTQDCSFQHSPISSDFAVKIRELSDYLLQDYPVTVASNLQYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 729 - protein, 364 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 730 - protein, 370 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVVRHLAQP

SEQ ID NO: 731 - protein, 364 aa
APPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGSKMQGLLERVNTEIHFVTKCAFQPYVEGGGGSPGEPSGPISTINPSPPSKESHKSPNMATPLGPASSVPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVIRHLAQP

SEQ ID NO: 732 - protein, 370 aa
ASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVAYVEGGGGSPGEPSGPISTINPSHPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 733 - protein, 370 aa
ANLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVIRHLAQP

SEQ ID NO: 734 - protein, 370 aa
ALQDEELCGGLWRLVLAQRLMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 735 - protein, 370 aa
ALCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDEEYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 736 - protein, 364 aa
ASKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 737 - protein, 364 aa; identical to SEQ ID NO: 736

SEQ ID NO: 738 - protein, 370 aa
ALCGGLWRLVLAQRWMERLKTVAGSKMQGLLERVNTEIHFVTKCAFQPPPSCLRFVQTNISRLLQETSEQLVALKPWITRQNFSRCLELQCRPDSSTLGGGSGGGSGGGSGGGSGGGSGTQDCSFQHSPISSNFAVKIRELSDYLLQDYPVTVASNLQDEEYVEGGGGSPGEPSGPIFTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 739 - protein, 370 aa
AELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDEYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 740 - protein, 370 aa
AEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQDYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 741 - protein, 370 aa
AQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 742 - protein, 364 aa
ATNISRLLQETSEQLVALKPWITRQNFSRCLELQCQPDSSTLGGGSGGGSGGGSGGGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 743 - protein, 355 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGGGSGGGSNMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 744 - protein, 370 aa
AQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDSAVKIRELSDYLLQDYPVTVASNLYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 745 - protein, 366 aa
ALCGGLWRLVLAQRWMERLKTVAGSKMQGLLERVNTEIHFVTKYAFQPPPSCLRFVQTNISRLLQETSEQLVALKPWITRQNFSRCLELQCRPDSSTLGGGSGGGSGGGSGGGSGTQDCSFQHSPISSDFAVKIRELSDYLLQDYPVTVASNLQDEEYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 746 - protein, 364 aa
ASKMQGLLERVNTEIHFVTKCAFQPPPSCLRFVQTNISRLLQETSEQLVALKPWITRQNFFRCLELQCQPDSSTLGGGSGGGSGGGSGGGTQDCSFQHSPISSDFAVKIRELSDYLLQDYPVTVASNLQDEELCGGLWRLVLAQRWMERLKTVAGYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 747 - protein, 378 aa
AQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGGGSGGGSGTQDCSFQHSPISSDFAVKIRELSDYLLQDYPVTVASNLYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 748 - protein, 364 aa
AQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLGATAPTTQDCSFQHSPISSDFAVKIRELSDYLLQDYPVTVASNLYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 749 - protein, 370 aa
AQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLGATAPTAGQPPLTQDCSFQHSPISSDFAVKIRELSDYLLQDYPVTVASNLYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 750 - protein, 378 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGGGSGGGSGTQDCSFQHSPISSDFAVKIRELSDYLLQDYPVTVASNLQYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 751 - protein, 378 aa
ADEELCGGLWRLVLAQRWMERPKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGGGSGGGSGTQDCSFQHSPISSDFAVKIRELSDYLLQDYPVTVASNLQYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 752 - protein, 370 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLGATAPTAGQPPLTQDCSFQHSPISSDFAVKIRELSDYLLQDYPVTVASNLQYVEGGGGTPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 753 - protein, 347 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPVETVFHRVSQDGLDLLTSTQDCSFQHSPISSDFAVKIRELSDYLLQDYPVTVASNLQYVEGGGGSPGGGSGGGSNMATPLGPASSLPQSFLLKSLEQVRKIQGDGAALQEKLCATNKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 754 - protein, 384 aa [sequence omitted]

SEQ ID NO: 755 - protein, 349 aa
ATQDCSFQHSPISSDFAVKIRELSDYLLQDYPVTVASNLQEPKSPDTHTSPPSPTPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPSAEPKSPDTHTSPPSPGSNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 756 - protein, 347 aa [sequence omitted]

SEQ ID NO: 757 - protein, 355 aa
ADEELCGGLWRLVLAQRWMERLKTVAGSKMQGLLERVNTEIHFVTKSAFQPPPSCLRFVQTNISRLLQETSEQLVALKPWITRQNFSRCLELQCQPDSSTLGGGSGGGSGGGSGGGSGGGSGTQDSSFQHSPISSDFAVKIRELSDYLLQDYPVTVASNLQYVEGGGGSPGGGSGGGSNMATPLGPASSLPQSFLLKSLEQVRKIQGDGAALQEKLCATNKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 758 - protein, 370 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMADEELCGGLWRLVLAQRWMERLKTVAGSKMQGLLERVNTEIHFVTKSAFQPPPSCLRFVQTNISRLLQETSEQLVALKPWITRQNFSRCLELQCQPDSSTLGGGSGGGSGGGSGGGSGGGSGTQDSSFQHSPISSDFAVKIRELSDYLLQDYPVTVASNLQ

SEQ ID NO: 759 - protein, 355 aa
ADEELCGGLWRLVLAQRWMERLKTVAGSKMQGLLERVNTEIHFVTKCAFQPPPSSLRFVQTNISRLLQETSEQLVALKPWITRQNFSRCLELQSQPDSSTLGGGSGGGSGGGSGGGSGGGSGTQDCSFQHSPISSDFAVKIRELSDYLLQDYPVTVASNLQYVEGGGGSPGGGSGGGSNMATPLGPASSLPQSFLLKSLEQVRKIQGDGAALQEKLCATNKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 760 - protein, 370 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMADEELCGGLWRLVLAQRWMERLKTVAGSKMQGLLERVNTEIHFVTKCAFQPPPSSLRFVQTNISRLLQETSEQLVALKPWITRQNFSRCLELQSQPDSSTLGGGSGGGSGGGSGGGSGGGSGTQDCSFQHSPISSDFAVKIRELSDYLLQDYPVTVASNLQ

SEQ ID NO: 761 - protein, 334 aa
ATQDSSFQHSPISSDFAVKIRELSDYLLQDYPVTVASNLQDEELCGGLWRLVLAQRWMERLKTVAGSKMQGLLERVNTEIHFVTKSAFQPPPSCLRFVQTNISRLLQETSEQLVALKPWITRQNFSRCLELQCQPDSSTLYVEGGGGSPGGGSGGGSNMATPLGPASSLPQSFLLKSLEQVRKIQGDGAALQEKLCATNKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 762 - protein, 334 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSSLRFVQTNISRLLQETSEQLVALKPWITRQNFSRCLELQSQPDSSTLYVEGGGGSPGGGSGGGSNMATPLGPASSLPQSFLLKSLEQVRKIQGDGAALQEKLCATNKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 763 - protein, 326 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQYVEGGGGSPGGGSGGGSNMATPLGPASSLPQSFLLKSLEQVRKIQGDGAALQEKLCATNKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 764 - protein, 334 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQSQPDSSTLYVEGGGGSPGGGSGGGSNMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 765 - protein, 334 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRRLELQSQPDSSTLYVEGGGGSPGGGSGGGSNMATPLGPASSLPQSFLLKSLEQVRKIQGDGAALQEKLCATNKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 766 - protein, 352 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGGGSGGGSNMATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQP

SEQ ID NO: 767 - protein, 367 aa
ATQGAMPAFASAFQRRAGGVLVASHLQSFLEVSYRVLRHLAQPSGGSGGSQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQ

SEQ ID NO: 768 - protein, 344 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQ

SEQ ID NO: 769 - protein, 335 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGEPSGPISTINPSPPSKESHKSPNMATQDCSFQHSPISSDFAVKIRELSDYLLQNYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 770 - protein, 550 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGGGSGGGSNMATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQ

SEQ ID NO: 771 - protein, 544 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGEPSGPISTINPSPPSKESHKSPNMATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTL

SEQ ID NO: 772 - protein, 565 aa
ATPLGPASSLPQSFLLKSLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQ

SEQ ID NO: 773 - protein, 502 aa
ANCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQ

SEQ ID NO: 774 - protein, 562 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGGGSGGGSNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQYVEGGGGSPGEPSGPISTINPSPPSKESHKSPNMATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQPSTPSTPGSEFGS

SEQ ID NO: 775 - protein, 490 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQYVEGGGGSPGEPSGPISTINPSPPSKESHKSPNMANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQYVEGGGGSPGEPSGPISTINPSPPSKESHKSPNMADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGTQDCSFQHSPISSDFAVKIRELSDYLLQDYPVTVASNLQ

SEQ ID NO: 776 - protein, 398 aa
ADEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLGGGSGGGSGGGSGGGSGGGSGTQDCSFQHSPISSDFAVKIRELSDYLLQDYPVTVASNLQEFKLEPRGPTIKPCPPCKCPAPNLLGGPSVFIFPPKIKDVLMISLSPIVTCVVVDVSEDDPDVQISWFVNNVEVHTAQTQTHREDYNSTLRAVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 777 - protein, 377 aa
ATQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLEFKLEPRGPTIKPCPPCKCPAPNLLGGPSVFIFPPKIKDVLMISLSPIVTCVVVDVSEDDPDVQISWFVNNVEVHTAQTQTHREDYNSTLRAVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 778 - protein, 4 aa
GGGS

SEQ ID NO: 779 - protein, 8 aa
GGGSGGGS

SEQ ID NO: 780 - protein, 12 aa
GGGSGGGSGGGS

SEQ ID NO: 781 - protein, 7 aa
SGGSGGS

SEQ ID NO: 782 - protein, 5 aa
EFGNM

SEQ ID NO: 783 - protein, 6 aa
EFGGNM

SEQ ID NO: 784 - protein, 9 aa
EFGGNGGNM

SEQ ID NO: 785 - protein, 7 aa
GGSDMAG

SEQ ID NO: 786 - protein, 5 aa
SGGNG

SEQ ID NO: 787 - protein, 10 aa
SGGNGSGGNG

SEQ ID NO: 788 - protein, 15 aa
SGGNGSGGNGSGGNG

SEQ ID NO: 789 - protein, 10 aa
SGGSGSGGSG

SEQ ID NO: 790 - protein, 15 aa
SGGSGSGGSGSGGSG

SEQ ID NO: 791 - protein, 6 aa
GGGSGG

SEQ ID NO: 792 - protein, 7 aa
GGGSGGG

SEQ ID NO: 793 - protein, 10 aa
GGGSGGGSGG

SEQ ID NO: 794 - protein, 13 aa
GGGSGGGSGGGSG

SEQ ID NO: 795 - protein, 15 aa
GGGSGGGSGGGSGGG

SEQ ID NO: 796 - protein, 21 aa
GGGSGGGSGGGSGGGSGGGSG

SEQ ID NO: 797 - protein, 21 aa
PPPWSPRPLGATAPTAGQPPL

SEQ ID NO: 798 - protein, 15 aa
PPPWSPRPLGATAPT

SEQ ID NO: 799 - protein, 16 aa
VETVFHRVSQDGLLTS

SEQ ID NO: 800 - protein, 36 aa
GGGSGGGSGGGSEGGGSEGGGSEGGGSEGGGSGGGS

SEQ ID NO: 801 - protein, 24 aa
ISEPSGPISTINPSPPSKESHKSP

SEQ ID NO: 802 - protein, 28 aa
IEGRISEPSGPISTINPSPPSKESHKSP

SEQ ID NO: 803 - protein, 112 aa
ANCSIMIDEIIHHLKRPPAPLLDPNNLNAEDVDILMERNLRLPNLESFVRAVKNLENASGIEAILRNLQPCLPSATAAPSRHPIIIKAGDWQEFREKLTFYLVTLEQAQEQQ

SEQ ID NO: 804 - protein, 112 aa
ANCSIMIDEIIHHLKRPPNPLLDPNNLNSEDMDILMERNLRTPNLLAFVRAVKHLENASGIEAILRNLQPCLPSATAAPSRHPIIIKAGDWQEFREKLTFYLVTLEQAQEQQ

SEQ ID NO: 805 - protein, 112 aa
ANCSIMIDEIIHHLKVPPAPLLDSNNLNSEDMDILMERNLRLPNLLAFVRAVKNLENASGIEAILRNLQPCLPSATAAPSRHPIIIKAGDWQEFREKLTFYLVTLEQAQEQQ

SEQ ID NO: 806 - protein, 111 aa
NCSIMIDEIIHHLKRPPAPLLDPNNLNDEDVSILMDRNLRLPNLESFVRAVKNLENASGIEAILRNLQPCLPSATAAPSRHPIIIKAGDWQEFREKLTFYLVTLEQAQEQQ

SEQ ID NO: 807 - DNA, 33 bp; single-stranded, linear
ctgaccatggcnacccaggactgctccttccaa

SEQ ID NO: 808 - DNA, 32 bp; single-stranded, linear
actgaagcttagggctgacactgcagctccag

SEQ ID NO: 809 - DNA, 32 bp; single-stranded, linear
actgaagcttacagggttgaggagtcgggctg

SEQ ID NO: 810 - DNA, 46 bp; single-stranded, linear
gactgccatggcnacycaggaytgytcyttycaacacagccccatc

SEQ ID NO: 811 - DNA, 46 bp; single-stranded, linear; identical to SEQ ID NO: 810

SEQ ID NO: 812 - DNA, 22 bp; single-stranded, linear
tgtccaaactcatcaatgtatc

SEQ ID NO: 813 - DNA, 38 bp; single-stranded, linear
catggccatggccgacgaggagctctgcgggggcctct

SEQ ID NO: 814 - DNA, 36 bp; single-stranded, linear
gctagaagcttactgcaggttggaggccacggtgac

SEQ ID NO: 815 - DNA, 38 bp; single-stranded, linear
catggccatggcctccaagatgcaaggcttgctggagc

SEQ ID NO: 816 - DNA, 36 bp; single-stranded, linear
gctagaagcttacccagcgacagtcttgagccgctc

SEQ ID NO: 817 - DNA, 36 bp; single-stranded, linear
catggccatggccccccccagctgtcttcgcttcgt

SEQ ID NO: 818 - DNA, 37 bp; single-stranded, linear
gctagaagcttagggctgaaaggcacatttggtgaca

SEQ ID NO: 819 - DNA, 42 bp; single-stranded, linear
ccctgtctggcggcaacggcacccaggactgctccttccaac

SEQ ID NO: 820 - DNA, 48 bp; single-stranded, linear
gcggtaacggcagtggaggtaatggcacccaggactgctccttccaac

SEQ ID NO: 821 - DNA, 57 bp; single-stranded, linear
acggcagtggtggcaatgggagcggcggaaatggaacccaggactgctccttccaac

SEQ ID NO: 822 - DNA, 38 bp; single-stranded, linear
gtgccgttgccgccagacagggttgaggagtcgggctg

SEQ ID NO: 823 - DNA, 48 bp; single-stranded, linear
attacctccactgccgttaccgcctgacagggttgaggagtcgggctg

SEQ ID NO: 824 - DNA, 54 bp; single-stranded, linear
gctcccattgccaccactgccgttacctccagacagggttgaggagtcgggctg

SEQ ID NO: 825 - DNA, 60 bp; single-stranded, linear
gatgaggatccggtggcaatgggagcggcggaaatggaacccaggactgctccttccacc

SEQ ID NO: 826 - DNA, 45 bp; single-stranded, linear
gatgacggatccgttacctccagacagggttgaggagtcgggctg

SEQ ID NO: 827 - DNA, 46 bp; single-stranded, linear
gatgacggatccggaggtaatggcacccaggactgctccttccaac

SEQ ID NO: 828 - DNA, 29 bp; single-stranded, linear
gactgccatggccgacgaggagctctgcg

SEQ ID NO: 829 - DNA, 28 bp; single-stranded, linear
gactcaagcttactgcaggttggaggcc

SEQ ID NO: 830 - DNA, 39 bp; single-stranded, linear
gactcgggatccggaggttctggcacccaggactgctcc

SEQ ID NO: 831 - DNA, 41 bp; single-stranded, linear
gactgggatccggtggcagtgggagcggcggatctggaacc

SEQ ID NO: 832 - DNA, 39 bp; single-stranded, linear
gacttgggatccactacctccagacagggttgaggagtc

SEQ ID NO: 833 - DNA, 39 bp; single-stranded, linear
actgacggatccaccgcccagggttgaggagtcgggctg

SEQ ID NO: 834 - DNA, 51 bp; single-stranded, linear
actgacggatccacctcctgacccaccgcccagggttgaggagtcgggctg

SEQ ID NO: 835 - DNA, 63 bp; single-stranded, linear
actgacggatccacctcctgacccacctcctgacccaccgcccagggttgaggagtcgggctg

SEQ ID NO: 836 - DNA, 28 bp; single-stranded, linear
acgtaaagcttacagggttgaggagtcg

SEQ ID NO: 837 - DNA, 40 bp; single-stranded, linear
gtcagtggatccggaggtacccaggactgctccttccaac

SEQ ID NO: 838 - DNA, 43 bp; single-stranded, linear
gtcagtggatccggaggtggcacccaggactgctccttccaac

SEQ ID NO: 839 - DNA, 60 bp; single-stranded, linear
tcagtggatccggaggtggctcagggggaggtagtggtacccaggactgctccttccaac

SEQ ID NO: 840 - DNA, 27 bp; single-stranded, linear
tagtccatggccacccaggactgctcc

SEQ ID NO: 841 - DNA, 31 bp; single-stranded, linear
gcattacgtagggctgacactgcagctccag

SEQ ID NO: 842 - DNA, 31 bp; single-stranded, linear
gcattacgtacagggttgaggagtcgggctg

SEQ ID NO: 843 - DNA, 37 bp; single-stranded, linear; identical to SEQ ID NO: 382

SEQ ID NO: 844 - DNA, 39 bp; single-stranded, linear; identical to SEQ ID NO: 387

SEQ ID NO: 845 - DNA, 37 bp; single-stranded, linear; identical to SEQ ID NO: 383

SEQ ID NO: 846 - DNA, 37 bp; single-stranded, linear
tctgacaagcttacacggtgactgggtaacttgaagc

SEQ ID NO: 847 - DNA, 38 bp; single-stranded, linear; identical to SEQ ID NO: 384

SEQ ID NO: 848 - DNA, 37 bp; single-stranded, linear; identical to SEQ ID NO: 389

SEQ ID NO: 849 - DNA, 38 bp; single-stranded, linear; identical to SEQ ID NO: 385

SEQ ID NO: 850 - DNA, 36 bp; single-stranded, linear; identical to SEQ ID NO: 391

SEQ ID NO: 851 - DNA, 38 bp; single-stranded, linear; identical to SEQ ID NO: 386

SEQ ID NO: 852 - DNA, 37 bp; single-stranded, linear; identical to SEQ ID NO: 392

SEQ ID NO: 853 - DNA, 33 bp; single-stranded, linear
gatcacatgtctacaaatcaagatctgcctgtg

SEQ ID NO: 854 - DNA, 30 bp; single-stranded, linear
gatcgaattcgttgtcttggatgaaaggga

SEQ ID NO: 855 - DNA, 32 bp; single-stranded, linear
acttgaattcatcatcctgggcctgttcgggc

SEQ ID NO: 856 - DNA, 30 bp; single-stranded, linear
actcaagcttagaagctccccagcgcctcc

SEQ ID NO: 857 - DNA, 64 bp; single-stranded, linear
ggatccaccatgagccgcctgcccgtcctgctcctgctccaactcctggtccgccccgccatgg

SEQ ID NO: 858 - protein, 174 aa
  Modified-site 1: /note= "Xaa at position 1 is Thr, Ser, Arg, Tyr or Gly;"
  Modified-site 2: /note= "Xaa at position 2 is Pro or Leu;"
  Modified-site 3: /note= "Xaa at position 3 is Leu, Arg, Tyr or Ser;"
  Modified-site 13: /note= "Xaa at position 13 is Phe, Ser, His, Thr or Pro;"
  Modified-site 16: /note= "Xaa at position 16 is Lys, Pro, Ser, thr or His;"
  Modified-site 17: /note= "Xaa at position 17 is Cys, Ser, Gly, Ala, Ile, Tyr or Arg;"
  Modified-site 18: /note= "Xaa at position 18 is Leu, Thr, Pro, His, Ile or Cys;"
  Modified-site 22: /note= "Xaa at position 22 is Arg, Tyr, Ser, Thr or Ala;"
  Modified-site 24: /note= "Xaa at position 24 is Ile, Pro, Tyr or Leu;"
  Modified-site 27: /note= "Xaa at position 27 is Asp, or Gly;"
  Modified-site 30: /note= "Xaa at position 30 is Ala, Ile, Leu or Gly;"
  Modified-site 34: /note= "Xaa at position 34 is Lys or Ser;"
  Modified-site 36: /note= "Xaa at position 36 is Cys or Ser;"
  Modified-site 42: /note= "Xaa at position 42 is Cys or Ser;"
  Modified-site 43: /note= "Xaa at position 43 is His, Thr, Gly, Val, Lys, Trp, Ala, Arg, Cys, or Leu;"
  Modified-site 44: /note= "Xaa at position 44 is Pro, Gly, Arg, Asp, Val, Ala, His, Trp, Gln, or Thr;"
  Modified-site 46: /note= "Xaa at position 46 is Glu, Arg, Phe, Arg, Ile or Ala;"
  Modified-site 47: /note= "Xaa at position 47 is Leu or Thr;"
  Modified-site 49: /note= "Xaa at position 49 is Leu, Phe, Arg or Ser;"
  Modified-site 50: /note= "Xaa at position 50 is Leu, Ile, His, Pro or Tyr;"
  Modified-site 54: /note= "Xaa at position 54 is Leu or His;"
  Modified-site 64: /note= "Xaa at position 64 is Cys or Ser;"
  Modified-site 67: /note= "Xaa at position 67 is Gln, Lys, Leu or Cys;"
  Modified-site 70: /note= "Xaa at position 70 is Gln, Pro, Leu, Arg or Ser;"
  Modified-site 74: /note= "Xaa at position 74 is Cys or Ser;"
  Modified-site 104: /note= "Xaa at position 104 is Asp, Gly or Val;"
  Modified-site 108: /note= "Xaa at position 108 is Leu, Ala, Val, Arg, Trp, Gln or Gly;"
  Modified-site 115: /note= "Xaa at position 115 is Thr, His, Leu or Ala;"
  Modified-site 120: /note= "Xaa at position 120 is Gln, Gly, Arg, Lys or His"
  Modified-site 123: /note= "Xaa at position 123 is Glu, Arg, Phe or Thr"
  Modified-site 144: /note= "Xaa at position 144 is Phe, His, Arg, Pro, Leu, Gln or Glu;"
  Modified-site 146: /note= "Xaa at position146 is Arg or Gln;"
  Modified-site 147: /note= "Xaa ap position 147 is Arg or Gln;"
  Modified-site 156: /note= "Xaa at position 156 is His, Gly or Ser;"
  Modified-site 159: /note= "Xaa at position 159 is Ser, Arg, Thr, Tyr, Val or Gly;"
  Modified-site 162: /note= "Xaa at position 162 is Glu, Leu, Gly or Trp;"
  Modified-site 163: /note= "Xaa at position 163 is Val, Gly, Arg or Ala;"
  Modified-site 169: /note= "Xaa at position 169 is Arg, Ser, Leu, Arg or Cys;"
  Modified-site 170: /note= "Xaa at position 170 is His, Arg or Ser;"
XXXGPASSLPQSXLLXXXEQVXKXQGXGAXLQEXLXATYKLXXXEXXVXXGHSXGIPWAPLSSXPSXALXLAGXLSQLHSGLFLYQGLLQALEGISPELGPTLXTLQXDVADFAXTIWQQMEXXGMAPALQPTQGAMPAFASAXQXXAGGVLVASXLQXFLXXSYRVLXXLAQP

SEQ ID NO: 859 - protein, 133 aa
  Modified-site 17: /note= "Xaa at position 17 is Ser, Lys, Gly, Asp, Met, Gln, or Arg;"
  Modified-site 18: /note= "Xaa at position 18 is Asn, His, Leu, Ile, Phe, Arg, or Gln;"
  Modified-site 19: /note= "Xaa at position 19 is Met, Phe, Ile, Arg, Gly, Ala, or Cys;"
  Modified-site 20: /note= "Xaa at position 20 is Ile, Cys, Gln, Glu, Arg, Pro, or Ala;"
  Modified-site 21: /note= "Xaa at position 21 is Asp, Phe, Lys, Arg, Ala, Gly, Glu, Gln, Asn, Thr, Ser or Val;"
  Modified-site 22: /note= "Xaa at position 22 is Glu, Trp, Pro, Ser, Ala, His, Asp, Asn, Gln, Leu, Val or Gly;"
  Modified-site 23: /note= "Xaa at position 23 is Ile, Val, Ala, Gly, Trp, Lys, Phe, Leu, Ser, or Arg;"
  Modified-site 24: /note= "Xaa at position 24 is Ile, Gly, Val, Arg, Ser, Phe, Leu;"
  Modified-site 25: /note= "Xaa at position 25 is Thr, His, Gly, Gln, Arg, Pro, or Ala;"
  Modified-site 26: /note= "Xaa at position 26 is His, Thr, Phe, Gly, Arg, Ala, Trp;"
  Modified-site 27: /note= "Xaa at position 27 is Leu, Gly, Arg, Thr, Ser, or Ala;"
  Modified-site 28: /note= "Xaa at position 28 is Lys, Arg, Leu, Gln, Gly, Pro, Val or Trp;"
  Modified-site 29: /note= "Xaa at position 29 is Gln, Asn, Leu, Pro, Arg, or Val;"
  Modified-site 30: /note= "Xaa at position 30 is Pro, His, Thr, Gly, Asp, Gln, Ser, Leu, or L..."
  Modified-site 31: /note= "Xaa at position 31 is Pro, Asp, Gly, Ala, Arg, Leu, or Gln;"
  Modified-site 32: /note= "Xaa at position 32 is Leu, Val, Arg, Gln, Asn, Gly, Ala, or Glu;"
  Modified-site 33: /note= "Xaa at position 33 is Pro, Leu, Gln, Ala, Thr, or Glu;"
  Modified-site 34: /note= "Xaa at position 34 is Leu, Val, Gly, Ser, Lys, Glu, Gln, Thr, Arg, Ala, Phe, Ile or Met;"
  Modified-site 35: /note= "Xaa at position 35 is Leu, Ala, Gly, Asn, Pro, Gln, or Val;"
  Modified-site 36: /note= "Xaa at position 36 is Asp, Leu, or Val;"
  Modified-site 37: /note= "Xaa at position 37 is Phe, Ser, Pro, Trp, or Ile;"
  Modified-site 38: /note= "Xaa at position 38 is Asn, or Ala;"
  Modified-site 40: /note= "Xaa at position 40 is Leu, Trp, or Arg;"
  Modified-site 41: /note= "Xaa at position 41 is Asn, Cys, Arg, Leu, His, Met, or pro;"
  Modified-site 42: /note= "Xaa at position 42 is Gly, Asp, Ser, Cys, Asn, Lys, Thr, Leu, Val, Glu, Phe, Tyr, Ile, Met or Ala;"
  Modified-site 43: /note= "Xaa at position 43 is Glu, Asn, Tyr, Leu, Phe, Asp, Ala, Cys, Gln, Arg, Thr, Gly, or Ser;"
  Modified-site 44: /note= "Xaa at position 44 is Asp, Ser, Leu, Arg, Lys, Thr, Met, Trp, Glu, Asn, Gln, Ala or Pro;"
  Modified-site 45: /note= "Xaa at position 45 is Gln, Pro, Phe, Val, Met, Leu, Thr, Lys, Trp, Asp, Asn, Arg, Ser,       Ala, Il
  Modified-site 46: /note= "Xaa at position 46 is Asp, Phe, Ser, Thr, Cys, Glu, Asn, Gln, Lys, His, Ala, Tyr, Ile, Val or Gly;"
  Modified-site 47: /note= "Xaa at position 47 is Ile, Gly, Val, Ser, Arg, Pro, or His;"
  Modified-site 48: /note= "Xaa at position 48 is Leu, Ser, Cys, Arg, Ile, His, Phe, Glu, Lys, Thr, Ala, Met, Val or Asn;"
  Modified-site 49: /note= "Xaa at position 49 is Met, Arg, Ala, Gly, Pro, Asn, His, or Asp;"
  Modified-site 50: /note= "Xaa at position 50 is Glu, Leu, Thr, Asp, Tyr, Lys, Asn, Ser, Ala, Ile, Val, His, Phe, Met or Gln;"
  Modified-site 51: /note= "Xaa at position 51 is Asn, Arg, Met, Pro, Ser, Thr, or his;"
  Modified-site 52: /note= "Xaa at position 52 is Asn, His, Arg, Leu, Gly, Ser, or Thr;"
  Modified-site 53: /note= "Xaa at position 53 is Leu, Thr, Ala, Gly, Glu, Pro, Lys, Ser, or M..."
  Modified-site 54: /note= "Xaa at position 54 is Arg, Asp, Ile, Ser, Val, Thr, Gln, Asn, Lys, His, Ala or Leu;"
  Modified-site 55: /note= "Xaa at position 55 is Arg, Thr, Val, Ser, Leu, or Gly;"
  Modified-site 56: /note= "Xaa at position 56 is Pro, Gly, Cys, Ser, Gln, Glu, Arg, His, Thr, Ala, Tyr, Phe, Leu, Val or Lys;"
  Modified-site 57: /note= "Xaa at position 57 is Asn or Gly;"
  Modified-site 58: /note= "Xaa at position 58 is Leu, Ser, Asp, Arg, Gln, Val, or Cys;"
  Modified-site 59: /note= "Xaa at position 59 is Glu, Tyr, His, Leu, Pro, or Arg;"
  Modified-site 60: /note= "Xaa at position 60 is Ala, Ser, Pro, Tyr, Asn, or Thr;"
  Modified-site 61: /note= "Xaa at position 61 is Phe, Asn, Glu, Pro, Lys, Arg, or Ser;"
  Modified-site 62: /note= "Xaa at position 62 is Asn, His, Val, Arg, Pro, Thr, Asp, or Ile;"
  Modified-site 63: /note= "Xaa at position 63 is Arg, Tyr, Trp, Lys, Ser, His, Pro, or Val;"
  Modified-site 64: /note= "Xaa at position 64 is Ala, Asn, Pro, Ser, or Lys;"
  Modified-site 65: /note= "Xaa at position 65 is Val, Thr, Pro, His, Leu, Phe, or Ser;"
  Modified-site 66: /note= "Xaa at position 66 is Lys, Ile, Arg, Val, Asn, Glu, or Ser;"
  Modified-site 67: /note= "Xaa at postion 67 is Ser, Ala, Phe, Val, Gly, Asn, Ile, Pro, or His;"
  Modified-site 68: /note= "Xaa at position 68 is Leu, Val, Trp, Ser, Ile, Phe, Thr, or His;"
  Modified-site 69: /note= "Xaa at position 69 is Gln, Ala, Pro, Thr, Glu, Arg, Trp, Gly, or L..."
  Modified-site 70: /note= "Xaa at position 70 is Asn, Leu, Val, Trp, pro, or Ala;"
  Modified-site 71: /note= "Xaa at position 71 is Ala, Met, Leu, Pro, Arg, Glu, Thr, Gln, Trp, or Asn;"
  Modified-site 72: /note= "Xaa at position 72 is Ser, Glu, Met, Ala, His, Asn, Arg, or Asp;"
  Modified-site 73: /note= "Xaa at position 73 is Ala, Glu, Asp, Leu, Ser, Gly, Thr, or Arg;"
  Modified-site 74: /note= "Xaa at position 74 is Ile, Met, Thr, Pro, Arg, Gly, Ala;"
  Modified-site 75: /note= "Xaa at position 75 is Glu, Lys, Gly, Asp, Pro, Trp, Arg, Ser, Gln, or Leu;"
  Modified-site 76: /note= "Xaa at position 76 is Ser, Val, Ala, Asn, Trp, Glu, Pro, Gly, or A..."
  Modified-site 77: /note= "Xaa at position 77 is Ile, Ser, Arg, Thr, or Leu;"
  Modified-site 78: /note= "Xaa at position 78 is Leu, Ala, Ser, Glu, Phe, Gly, or Arg;"
  Modified-site 79: /note= "Xaa at position 79 is Lys, Thr, Asn, Met, Arg, Ile, Gly, or Asp;"
  Modified-site 80: /note= "Xaa position at 80 is Asn, Trp, Val, Gly, Thr, Leu, Glu, or Arg;"
  Modified-site 81: /note= "Xaa at position 81 is Leu, Gln, Gly, Ala, Trp, Arg, Val, or Lys;"
  Modified-site 82: /note= "Xaa at position 82 is Leu, Gln, Lys, Trp, Arg, Asp, Glu, Asn, His, Thr, Ser, Ala, Tyr, Phe, Ile, Met
  Modified-site 83: /note= "Xaa at position 83 is Pro, Ala, Thr, Trp, Arg, or Met;"
  Modified-site 84: /note= "Xaa at position 84 is Cys, Glu, Gly, Arg, Met, or Val;"
  Modified-site 85: /note= "Xaa at position 85 is Leu, Asn, Val, or Gln;"
  Modified-site 86: /note= "Xaa at position 86 is Pro, Cys, Arg, Ala, or Lys;"
  Modified-site 87: /note= "Xaa at position 87 is Leu, Ser, Trp, or Gly;"
  Modified-site 88: /note= "Xaa at position 88 is Ala, Lys, Arg, Val, or Trp;"
  Modified-site 89: /note= "Xaa at position 89 is Thr, Asp, Cys, Leu, Val, Glu, His, Asn, or S..."
  Modified-site 90: /note= "Xaa at position 90 is Ala, Pro, Ser, Thr, Gly, Asp, Ile, or ,Met;"
  Modified-site 91: /note= "Xaa at position 91 is Ala, Pro, Ser, Thr, Phe, Leu, Asp, or His;"
  Modified-site 92: /note= "Xaa at position 92 is Pro, Phe, Arg, Ser, Lys, His, Ala, Gly, Ile or Leu;"
  Modified-site 93: /note= "Xaa at position 93 is Thr, Asp, Ser, Asn, Pro, Ala, Leu, or Arg;"
  Modified-site 94: /note= "Xaa at position 94 is Arg, Ile, Ser, Glu, Leu, Val, Gln, Lys, His, Ala, or Pro;"
  Modified-site 95: /note= "Xaa at position 95 is His, Gln, Pro, Arg, Val, Leu, Gly, Thr, Asn, Lys, Ser, Ala, Trp, Phe, Ile, or
  Modified-site 96: /note= "Xaa at position 96 is Pro, Lys, Tyr, Gly, Ile, or Thr;"
  Modified-site 97: /note= "Xaa at position 97 is Ile, Val, Lys, Ala, or Asn;"
  Modified-site 98: /note= "Xaa at position 98 is His, Ile, Asn, Leu, Asp, Ala, Thr, Glu, Gln, Ser, Phe, Met, Val, Lys, Arg, Tyr
  Modified-site 99: /note= "Xaa at position 99 is Ile, Leu, Arg, Asp, Val, Pro, Gln, Gly, Ser, Phe, or His;"
  Modified-site 100: /note= "Xaa at position 100 is Lys, Tyr, Leu, His, Arg, Ile, Ser, Gln, or ..."
  Modified-site 101: /note= "Xaa at position is Asp, Pro, Met, Lys, His, Thr, Val, Tyr, Glu, Asn, Ser, Ala, Gly, Ile, Leu, or
  Modified-site 102: /note= "Xaa at position 102 is Gly, Leu, Glu, Lys, Ser, Tyr, or Pro;"
  Modified-site 103: /note= "Xaa at position 103 is Asp, or Ser;"
  Modified-site 104: /note= "Xaa at position 104 is Trp, Val, Cys, Tyr, Thr, Met, Pro, Leu, Gln, Lys, Ala, Phe, or Gly;"
  Modified-site 105: /note= "Xaa at position 105 is Asn, Pro, Ala, Phe, Ser, Trp, Gln, Tyr, Leu, Lys, Ile, Asp, or His;"
  Modified-site 106: /note= "Xaa at position 106 is Glu, Ser, Ala, Lys, Thr, Ile, Gly, or Pro;"
  Modified-site 108: /note= "Xaa at position 108 is Arg, Lys, Asp, Leu, Thr, Ile, Gln, His, Ser, Ala or Pro;"
  Modified-site 109: /note= "Xaa at position 109 is Arg, Thr, Pro, Glu, Tyr, Leu, Ser, or Gly;"
  Modified-site 110: /note= "Xaa at position 110 is Lys, Ala, Asn, Thr, Leu, Arg, Gln, His, Glu, Ser, or Trp;"
  Modified-site 111: /note= "Xaa at position 111 is Leu, Ile, Arg, Asp, or Met;"
  Modified-site 112: /note= "Xaa at position 112 is Thr, Val, Gln, Tyr, Glu, His, Ser, or Phe;"
  Modified-site 113: /note= "Xaa at position 113 is Phe, Ser, Cys, His, Gly, Trp, Tyr, Asp, Lys, Leu, Ile, Val or Asn;"
  Modified-site 114: /note= "Xaa at position 114 is Tyr, Cys, His, Ser, Trp, Arg, or Leu;"
  Modified-site 115: /note= "Xaa at position 115 is Leu, Asn, Val, Pro, Arg, Ala, His, Thr, Trp, or Met;"
  Modified-site 116: /note= "Xaa at position 116 is Lys, Leu, Pro, Thr, Met, Asp, Val, Glu, Arg, Trp, Ser, Asn, His, Ala, Tyr, Phe
  Modified-site 117: /note= "Xaa at position 117 is Thr, Ser, Asn, Ile, Trp, Lys, or Pro;"
  Modified-site 118: /note= "Xaa at position 118 is Leu, Ser, Pro, Ala, Glu, Cys, Asp, or Tyr;"
  Modified-site 119: /note= "Xaa at position 119 is Glu, Ser, Lys, Pro, leu, Thr, Tyr, or Arg;"
  Modified-site 120: /note= "Xaa at position 120 is Asn, Ala, Pro, Leu, His, Val, or Gln;"
  Modified-site 121: /note= "Xaa at position 121 is Ala, Ser, Ile, Asn, Pro, Lys, Asp, or Gly;"
  Modified-site 122: /note= "Xaa at position 122 is Gln, Ser, Met, Trp, Arg, Phe, Pro, His, Ile, Tyr, or Cys;"
  Modified-site 123: /note= "Xaa at position 123 is Ala, Met, Glu, His, Ser, Pro, Tyr, or Leu;"
APMTQTTSLKTSWVNCXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXFXXXXXXXXXXXXXXXXQQTTLSLAIF

SEQ ID NO: 860 - protein, 153 aa
  Modified-site 112: /note= "position 112 is deleted or Leu, Ala,VAl, Ile, Pro, Phe, Trp or Met"
  Modified-site 113: /note= "positoin 113 is deleted or Pro, Phe, Ala, Val, Leu, Ile, Trp or Met"
  Modified-site 114: /note= "position 114 is deleted or Pro, Phe, Ala, Val, Leu, Ile, Trp or Met"
  Modified-site 115: /note= "positon 115 is deleted or Gln, Gly, Ser, Thr, Tyr, or Asn"
SPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQXXXXGRTTAHKDPNAIFLSFQHLLRGKVRFLMLVGGSTLCVR

SEQ ID NO: 861 - protein, 1 aa
  Protein 1: /note= "where x=(glyglyglyser)n and where n is an integer"
X

SEQ ID NO: 862 - protein, 1 aa
  Peptide 1: /note= "where x=(glyglyglyglyser)n and where n is an integer"
X

SEQ ID NO: 863 - protein, 1 aa
  Protein 1: /note= "where x= (glyglyglyglyglyser)n and where n is an integer"
X

SEQ ID NO: 864 - protein, 1 aa
  Protein 1: /note= "where x= (gly n ser)n and where n is an integer"
X

SEQ ID NO: 865 - protein, 1 aa
  Protein 1: /note= "where x=(alaglyser)n and where n is an integer"
X

What is claimed is:

1. A hematopoietic protein comprising; an amino acid sequence of the formula:

$Met^{-1} R_1-L_1-R_2$, $Met^{-2} Ala^{-1} P_1-L_1-R_2$, $Ala^{-1} R_1-L_1-R_2$, $R_1-L_1-R_2$, $Met^{-1} R_2-L_1-R_1$, $Met^{-2} Ala^{-1} R_2-L_1-R_1$, $Ala^{-1} R_2-L_1-R_1$, $R_2-L_1-R_1$, $Met^{-1} R_1-R_2$, $Met^{-2} Ala^{-1} R_1-R_2$, $Ala^{-1} R_1-R_2$, $R_1-R_2$, $Met^{-1} R_2-R_1$, $Met^{-2} Ala^{-1} R_2R_1$, $Ala^{-1} R_2-R_1$, or $R_2-R_1$, wherein $R_1$ is a biologically active human flt-3 receptor agonist polypeptide, comprising; a modified flt-3 ligand amino acid sequence of the Formula:

```
                                    SEQ ID NO:466
ThrGlnAspCysSerPheGlnHisSerProIleSerSerAspPheAlaVal
                        10

LysIleArgGluLeuSerAspTyrLeuLeuGlnAspTyrProValThrVal
        20                          30

AlaSerAsnLeuGlnAspGluGluLeuCysGlyGlyLeuTrpArgLeuVal
                40                          50

LeuAlaGlnArgTrpMetGluArgLeuLysThrValAlaGlySerLysMet
                        60

GlnGlyLeuLeuGluArgValAsnThrGluIleHisPheValThrLysCys
        70                          80

AlaPheGlnProProProSerCysLeuArgPheValGlnThrAsnIleSer
                90                          100

ArgLeuLeuGlnGluThrSerGluGlnLeuValAlaLeuLysProTrpIle
                       110

ThrArgGlnAsnPheSerArgCysLeuGluLeuGlnCysGlnProAspSer
120                                 130

SerThrLeu
``` wherein optionally from 1 to 7 residues of amino acids 133–139 of SEQ ID NO:466 are deleted; and wherein said modification comprises tire linear rearrangement of SEQ ID NO:466; wherein the N-terminus is joined to the C-terminus directly or through a linker ($L_2$) capable of joining the N-terminus to the C-terminus and new C- and N-termini are created between the amino acid residue pairs of SEQ ID NO:466 selected from the group consisting of:

28–29, 29–30, 30–31, 31–32, 32–33, 34–35, 36–37, 37–38, 38–39, 40–41, 41–42, 42–43, 64–65, 65–66, 66–67, 86–87, 87–88, 88–89, 89–90, 90–91, 91–92, 92–93, 93–94, 94–95, 95–96, 96–97, 97–98, 98–99, 99–100, 100–101, 101–102, and 102–103;

wherein $R_2$ is selected from the group consisting of:

(I) a biologically active human flt-3 receptor agonist polypeptide, comprising; a mordified flt-3 ligand amino acid sequence of the Formula:

```
                                    SEQ ID NO:466
ThrGlnAspCysSerPheGlnHisSerProIleSerSerAspPheAlaVal
                        10

LysIleArgGluLeuSerAspTyrLeuLeuGlnAspTyrProValThrVal
        20                          30

AlaSerAsnLeuGlnAspGluGluLeuCysGlyGlyLeuTrpArgLeuVal
                40                          50

LeuAlaGlnArgTrpMetGluArgLeuLysThrValAlaGlySerLysMet
                        60

GlnGlyLeuLeuGluArgValAsnThrGluIleHisPheValThrLysCys
        70                          80

AlaPheGlnProProProSerCysLeuArgPheValGlnThrAsnIleSer
                90                          100

ArgLeuLeuGlnGluThrSerGluGlnLeuValAlaLeuLysProTrpIle
                       110

ThrArgGlnAsnPheSerArgCysLeuGluLeuGlnCysGlnProAspSer
120                                 130

SerThrLeu
``` wherein optionally from 1 to 7 residues of amino acids 133–139 of SEQ ID NO:466 are deleted; and wherein said modification comprises the linear rearrangement of SEQ ID NO:466; wherein the N-terminus is joined to the C-terminus directly or through a linker ($L_2$) capable of joining the N-terminus to the C-terminus and new C- and N-termini are created between the amino acid residue pairs of SEQ ID NO:466 selected from the group consisting of:

28–29, 29–30, 30–31, 31–32, 32–33, 34–35, 36–37, 37–38, 38–39, 40–41, 41–42, 42–43, 64–65, 65–66, 66–67, 86–87, 87–88, 88–89, 89–90, 90–91, 91–92, 92–93, 93–94, 94–95, 95–96, 96–97, 97–98, 98–99, 99–100, 100–101, 101–102, and 102–103;

(II) a biologically active modified human IL-3 amino acid sequence of SEQ ID NO:859 wherein Xaa at position 17 is Ser, Lys, Gly, Asp, Met, Gln, or Arg;

Xaa at position 18 is Asn, His, Leu, Ile, Phe, Arg, or Gln;
Xaa at position 19 is Met, Phe, Ile, Arg, Gly, Ala, or Cys;
Xaa at position 20 is Ile, Cys, Gln, Glu, Arg, Pro, or Ala;
Xaa at position 21 is Asp, Phe, Lys, Arg, Ala, Gly, Glu, Gln, Asn, Thr, Ser or Val;
Xaa at position 22 is Glu, Trp, Pro, Ser, Ala, His, Asp, Asn, Gln, Leu, Val or Gly;
Xaa at position 23 is Ile, Val, Ala, Gly, Trp, Lys, Phe, Leu, Ser, or Arg;
Xaa at position 24 is Ile, Gly, Val, Arg, Ser, Phe, or Leu;
Xaa at position 25 is Thr, His, Gly, Gln, Arg, Pro, or Ala;

Xaa at position 26 is His, Thr, Phe, Gly, Arg, Ala, or Trp;
Xaa at position 27 is Leu, Gly, Arg, Thr, Ser, or Ala;
Xaa at position 28 is Lys, Arg, Leu, Gln, Gly, Pro, Val or Trp;
Xaa at position 29 is Gln, Asn, Leu, Pro, Arg, or Val;
Xaa at position 30 is Pro, His, Thr, Gly, Asp, Gln, Ser, Leu, or Lys;
Xaa at position 31 is Pro, Asp, Gly, Ala, Arg, Leu, or Gln;
Xaa at position 32 is Leu, Val, Arg, Gln, Asn, Gly, Ala, or Glu;
Xaa at position 33 is Pro, Leu, Gln, Ala, Thr, or Glu;
Xaa at position 34 is Leu, Val, Gly, Ser, Lys, Glu, Gln, Thr, Arg, Ala, Phe, Ile or Met;
Xaa at position 35 is Leu, Ala, Gly, Asn, Pro, Gln, or Val;
Xaa at position 36 is Asp, Leu, or Val;
Xaa at position 37 is Phe, Ser, Pro, Trp, or Ile;
Xaa at position 38 is Asn, or Ala;
Xaa at position 40 is Leu, Trp, or Arg;
Xaa at position 41 is Asn, Cys, Arg, Leu, His, Met, or Pro;
Xaa at position 42 is Gly, Asp, Ser, Cys, Asn, Lys, Thr, Leu, Val, Glu, Phe, Tyr, Ile, Met or Ala;
Xaa at position 43 is Glu, Asn, Tyr, Leu, Phe, Asp, Ala, Cys, Gln, Arg, Thr, Gly or Ser;
Xaa at position 44 is Asp, Ser, Leu, Arg, Lys, Thr, Met, Trp, Glu, Asn, Gln, Ala or Pro;
Xaa at position 45 is Gln, Pro, Phe, Val, Met, Leu, Thr, Lys, Trp, Asp, Asn, Arg, Ser, Ala, Ile, Glu or His;
Xaa at position 46 is Asp, Phe, Ser, Thr, Cys, Glu, Asn, Gln, Lys, His, Ala, Tyr, Ile, Val or Gly;
Xaa at position 47 is Ile, Gly, Val, Ser, Arg, Pro, or His;
Xaa at position 48 is Leu, Ser, Cys, Arg, Ile, His, Phe, Glu, Lys, Thr, Ala, Met, Val or Asn;
Xaa at position 49 is Met, Arg, Ala, Gly, Pro, Asn, His, or Asp;
Xaa at position 50 is Glu, Leu, Thr, Asp, Tyr, Lys, Asn, Ser, Ala, Ile, Val, His, Phe, Met or Gln;
Xaa at position 51 is Asn, Arg, Met, Pro, Ser, Thr, or His;
Xaa at position 52 is Asn, His, Arg, Leu, Gly, Ser, or Thr;
Xaa at position 53 is Leu, Thr, Ala, Gly, Glu, Pro, Lys, Ser, or Met;
Xaa at position 54 is Arg, Asp, Ile, Ser, Val, Thr, Gln, Asn, Lys, His, Ala or Leu;
Xaa at position 55 is Arg, Thr, Val, Ser, Leu, or Gly;
Xaa at position 56 is Pro, Gly, Cys, Ser, Gln, Glu, Arg, His, Thr, Ala, Tyr, Phe, Leu, Val or Lys;
Xaa at position 57 is Asn or Gly;
Xaa at position 58 is Leu, Ser, Asp, Arg, Gln, Val, or Cys;
Xaa at position 59 is Glu Tyr, His, Leu, Pro, or Arg;
Xaa at position 60 is Ala, Ser, Pro, Tyr, Asn, or Thr;
Xaa at position 61 is Phe, Asn, Glu, Pro, Lys, Arg, or Ser;
Xaa at position 62 is Asn, His, Val, Arg, Pro, Thr, Asp, or Ile;
Xaa at position 63 is Arg, Tyr, Trp, Lys, Ser, His, Pro, or Val;
Xaa at position 64 is Ala, Asn, Pro, Ser, or Lys;
Xaa at position 65 is Val, Thr, Pro, His, Leu, Phe, or Ser;
Xaa at position 66 is Lys, Ile, Arg, Val, Asn, Glu, or Ser;
Xaa at position 67 is Ser, Ala, Phe, Val, Gly, Asn, Ile, Pro, or His;
Xaa at position 68 is Leu, Val, Trp, Ser, Ile, Phe, Thr, or His;
Xaa at position 69 is Gln, Ala, Pro, Thr, Glu, Arg, Trp, Gly, or Leu;
Xaa at position 70 is Asn, Leu, Val, Trp, Pro, or Ala;
Xaa at position 71 is Ala, Met, Leu, Pro, Arg, Glu, Thr, Gln, Trp, or Asn;
Xaa at position 72 is Ser, Glu, Met, Ala, His, Asn, Arg, or Asp;
Xaa at position 73 is Ala, Glu, Asp, Leu, Ser, Gly, Thr, or Arg;
Xaa at position 74 is Ile, Met, Thr, Pro, Arg, Gly, Ala;
Xaa at position 75 is Glu, Lys, Gly, Asp, Pro, Trp, Arg, Ser, Gln, or Leu;
Xaa at position 76 is Ser, Val, Ala, Asn, Trp, Glu, Pro, Gly, or Asp;
Xaa at position 77 is Ile, Ser, Arg, Thr, or Leu;
Xaa at position 78 is Leu, Ala, Ser, Glu, Phe, Gly, or Arg;
Xaa at position 79 is Lys, Thr, Asn, Met, Arg, Ile, Gly, or Asp;
Xaa at position 80 is Asn, Trp, Val, Gly, Thr, Leu, Glu, or Arg;
Xaa at position 81 is Leu, Gln, Gly, Ala, Trp, Arg, Val, or Lys;
Xaa at position 82 is Leu, Gln, Lys, Trp, Arg, Asp, Glu, Asn, His, Thr, Ser, Ala, Tyr, Phe, Ile, Met or Val;

Xaa at position 83 is Pro, Ala, Thr, Trp, Arg, or Met;

Xaa at position 84 is Cys, Glu, Gly, Arg, Met, or Val;

Xaa at position 85 is Leu, Asn, Val, or Gln;

Xaa at position 86 is Pro, Cys, Arg, Ala, or Lys;

Xaa at position 87 is Leu, Ser, Trp, or Gly;

Xaa at position 88 is Ala, Lys, Arg, Val, or Trp;

Xaa at position 89 is Thr, Asp, Cys, Leu, Val, Glu, His, Asn, or Ser;

Xaa at position 90 is Ala, Pro, Ser, Thr, Gly, Asp, Ile, or Met;

Xaa at position 91 is Ala, Pro, Ser, Thr, Phe, Leu, Asp, or His;

Xaa at position 92 is Pro, Phe, Arg, Ser, Lys, His, Ala, Gly, Ile or Leu;

Xaa at position 93 is Thr, Asp, Ser, Asn, Pro, Ala, Leu, or Arg;

Xaa at position 94 is Arg, Ile, Ser, Glu, Leu, Val, Gln, Lys, His, Ala, or Pro;

Xaa at position 95 is His, Gln, Pro, Arg, Val, Leu, Gly, Thr, Asn, Lys, Ser, Ala, Trp, Phe, Ile, or Tyr;

Xaa at position 96 is Pro, Lys, Tyr, Gly, Ile, or Thr;

Xaa at position 97 is Ile, Val, Lys, Ala, or Asn;

Xaa at position 98 is His, Ile, Asn, Leu, Asp, Ala, Thr, Glu, Gln, Ser, Phe, Met, Val, Lys, Arg, Tyr or Pro;

Xaa at position 99 is Ile, Leu, Arg, Asp, Val, Pro, Gln, Gly, Ser, Phe, or His;

Xaa at position 100 is Lys, Tyr, Leu, His, Arg, Ile, Ser, Gln, or Pro;

Xaa at position 101 is Asp, Pro, Met, Lys, His, Thr, Val, Tyr, Glu, Asn, Ser, Ala, Gly, Ile, Leu, or Gln;

Xaa at position 102 is Gly, Leu, Glu, Lys, Ser, Tyr, or Pro;

Xaa at position 103 is Asp, or Ser;

Xaa at position 104 is Trp, Val, Cys, Tyr, Thr, Met, Pro, Leu, Gln, Lys, Ala, Phe, or Gly;

Xaa at position 105 is Asn, Pro, Ala, Phe, Ser, Trp, Gln, Tyr, Leu, Lys, Ile, Asp, or His;

Xaa at position 106 is Glu, Ser, Ala, Lys, Thr, Ile, Gly, or Pro;

Xaa at position 108 is Arg, Lys, Asp, Leu, Thr, Ile, Gln, His, Ser, Ala or Pro;

Xaa at position 109 is Arg, Thr, Pro, Glu, Tyr, Leu, Ser, or Gly;

Xaa at position 110 is Lys, Ala, Asn, Thr, Leu, Arg, Gln, His, Glu, Ser, or Trp;

Xaa at position 111 is Leu, Ile, Arg, Asp, or Met;

Xaa at position 112 is Thr, Val, Gln, Tyr, Glu, His, Ser, or Phe;

Xaa at position 113 is Phe, Ser, Cys, His, Gly, Trp, Tyr, Asp, Lys, Leu, Ile, Val or Asn;

Xaa at position 114 is Tyr, Cys, His, Ser, Trp, Arg, or Leu;

Xaa at position 115 is Leu, Asn, Val, Pro, Arg, Ala, His, Thr, Trp, or Met;

Xaa at position 116 is Lys, Leu, Pro, Thr, Met, Asp, Val, Glu, Arg, Trp, Ser, Asn, His, Ala, Tyr, Phe, Gln, or Ile;

Xaa at position 117 is Thr, Ser, Asn, Ile, Trp, Lys, or Pro;

Xaa at position 118 is Leu, Ser, Pro, Ala, Glu, Cys, Asp, or Tyr;

Xaa at position 119 is Glu, Ser, Lys, Pro, Leu, Thr, Tyr, or Arg;

Xaa at position 120 is Asn, Ala, Pro, Leu, His, Val, or Gln;

Xaa at position 121 is Ala, Ser, Ile, Asn, Pro, Lys, Asp, or Gly;

Xaa at position 122 is Gln, Ser, Met, Trp, Arg, Phe, Pro, His, Ile, Tyr, or Cys;

Xaa at position 123 is Ala, Met, Glu, His, Ser, Pro, Tyr, or Leu;

wherein optionally amino acids 1–14 of SEQ ID NO:859 are deleted and/or amino acids 118–133 of SEQ ID NO:859 are deleted; and wherein from 1 to 44 of the amino acids designated by Xaa in SEQ ID NO:859 are different from the corresponding amino acids of native (1–133) human interleukin-3; and (III) a factor selected from the group consisting of: a colony stimulating factor, a cytokine, a lymphokine, an interleukin, and a hematopoietic growth factor; and wherein $L_1$ is a linker capable of linking $R_1$ to $R_2$.

2. A hematopoietic protein comprising; an amino acid sequence of the formula:

Met$^{-1}$ $R_1$-$L_1$-$R_2$, Met$^{-2}$ Ala$^{-1}$ $R_1$-$L_1$-$R_2$, Ala$^{-1}$ $R_1$-$L_1$-$R_2$, $R_1$-$L_1$-$R_2$, Met$^{-1}$ $R_2$-$L_1$-$R_1$, Met$^{-2}$ Ala$^{-1}$ $R_2$-$L_1$-$R_1$, Ala$^{-1}$ $R_2$-$L_1$-$R_1$, $R_2$-$L_1$-$R_1$, Met$^{-1}$ $R_1$-$R_2$, Met$^{-2}$ Ala$^{-1}$ $R_1$-$R_2$, Ala$^{-1}$ $R_1$-$R_2$, $R_1$-$R_2$, Met$^{-1}$ $R_2$-$R_1$, Met$^{-2}$ Ala$^{-1}$ $R_2R_1$, Ala$^{-1}$ $R_2$-$R_1$, or $P_2$-$R_1$, wherein $R_1$ is a biologically active human flt-3 receptor agonist polypeptide, comprising; a modified flt-3 ligand amino acid sequence of the Formula:

SEQ ID NO:466
ThrGlnAspCysSerPheGlnHisSerProIleSerSerAspPheAlaVal
10

LysIleArgGluLeuSerAspTyrLeuLeuGlnAspTyrProValThrVal
20                                           30

-continued
AlaSerAsnLeuGlnAspGluGluLeuCysGlyGlyLeuTrpArgLeuVal
40                                           50

LeuAlaGlnArgTrpMetGluArgLeuLysThrValAlaGlySerLysMet
60

GlnGlyLeuLeuGluArgValAsnThrGluIleHisPheValThrLysCys
70                                           80

AlaPheGlnProProProSerCysLeuArgPheValGlnThrAsnIleSer
90                                          100

ArgLeuLeuGlnGluThrSerGluGlnLeuValAlaLeuLysProTrpIle
110

ThrArgGlnAsnPheSerArgCysLeuGluLeuGlnCysGlnProAspSer
120                                         130

SerThrLeu wherein optionally from 1 to 7 residues of amino acids 133–139 of SEQ ID NO:466 are deleted; and wherein said modification comprises tire linear rearrangement of SEQ ID NO:466; wherein the N-terminus is joined to the C-terminus directly or through a linker ($L_2$) capable of joining the N-terminus to the C-terminus and new C- and N-termini are created between the amino acid residue pairs of SEQ ID NO:466 selected from the group consisting of:

28–29, 29–30, 30–31, 31–32, 32–33, 34–35, 36–37, 37–38, 38–39, 40–41, 41–42, 42–43, 64–65, 65–66, 66–67, 86–87, 87–88, 88–89, 89–90, 90–91, 91–92, 92–93, 93–94, 94–95, 95–96, 96–97, 97–98, 98–99, 99–100, 100–101, 101–102, and 102–103;

wherein $R_2$ is selected from the group consisting of:
(I) a biologically active human IL-3 amino acid sequence of SEQ ID NO:859 wherein Xaa at position 17 is Ser, Lys, Gly, Asp, Met, Gln, or Arg;

Xaa at position 18 is Asn, His, Leu, Ile, Phe, Arg, or Gln;

Xaa at position 19 is Met, Phe, Ile, Arg, Gly, Ala, or Cys;

Xaa at position 20 is Ile, Cys, Gln, Glu, Arg, Pro, or Ala;

Xaa at position 21 is Asp, Phe, Lys, Arg, Ala, Gly, Glu, Gln, Asn, Thr, Ser or Val;

Xaa at position 22 is Glu, Trp, Pro, Ser, Ala, His, Asp, Asn, Gln, Leu, Val or Gly;

Xaa at position 23 is Ile, Val, Ala, Gly, Trp, Lys, Phe, Leu, Ser, or Arg;

Xaa at position 24 is Ile, Gly, Val, Arg, Ser, Phe, or Leu;

Xaa at position 25 is Thr, His, Gly, Gln, Arg, Pro, or Ala;

Xaa at position 26 is His, Thr, Phe, Gly, Arg, Ala, or Trp;

Xaa at position 27 is Leu, Gly, Arg, Thr, Ser, or Ala;

Xaa at position 28 is Lys, Arg, Leu, Gln, Gly, Pro, Val or Trp;

Xaa at position 29 is Gln, Asn, Leu, Pro, Arg, or Val;

Xaa at position 30 is Pro, His, Thr, Gly, Asp, Gln, Ser, Leu, or Lys;

Xaa at position 31 is Pro, Asp, Gly, Ala, Arg, Leu, or Gln;

Xaa at position 32 is Leu, Val, Arg, Gln, Asn, Gly, Ala, or Glu;

Xaa at position 33 is Pro, Leu, Gln, Ala, Thr, or Glu;

Xaa at position 34 is Leu, Val, Gly, Ser, Lys, Glu, Gln, Thr, Arg, Ala, Phe, Ile or Met;

Xaa at position 35 is Leu, Ala, Gly, Asn, Pro, Gln, or Val;

Xaa at position 36 is Asp, Leu, or Val;

Xaa at position 37 is Phe, Ser, Pro, Trp, or Ile;
Xaa at position 38 is Asn, or Ala;
Xaa at position 40 is Leu, Trp, or Arg;
Xaa at position 41 is Asn, Cys, Arg, Leu, His, Met, or Pro;
Xaa at position 42 is Gly, Asp, Ser, Cys, Asn, Lys, Thr, Leu, Val, Glu, Phe, Tyr, Ile, Met or Ala;
Xaa at position 43 is Glu, Asn, Tyr, Leu, Phe, Asp, Ala, Cys, Gln, Arg, Thr, Gly or Ser;
Xaa at position 44 is Asp, Ser, Leu, Arg, Lys, Thr, Met, Trp, Glu, Asn, Gln, Ala or Pro;
Xaa at position 45 is Gln, Pro, Phe, Val, Met, Leu, Thr, Lys, Trp, Asp, Asn, Arg, Ser, Ala, Ile, Glu or His;
Xaa at position 46 is Asp, Phe, Ser, Thr, Cys, Glu, Asn, Gln, Lys, His, Ala, Tyr, Ile, Val or Gly;
Xaa at position 47 is Ile, Gly, Val, Ser, Arg, Pro, or His;
Xaa at position 48 is Leu, Ser, Cys, Arg, Ile, His, Phe, Glu, Lys, Thr, Ala, Met, Val or Asn;
Xaa at position 49 is Met, Arg, Ala, Gly, Pro, Asn, His, or Asp;
Xaa at position 50 is Glu, Leu, Thr, Asp, Tyr, Lys, Asn, Ser, Ala, Ile, Val, His, Phe, Met or Gln;
Xaa at position 51 is Asn, Arg, Met, Pro, Ser, Thr, or His;
Xaa at position 52 is Asn, His, Arg, Leu, Gly, Ser, or Thr;
Xaa at position 53 is Leu, Thr, Ala, Gly, Glu, Pro, Lys, Ser, or Met;
Xaa at position 54 is Arg, Asp, Ile, Ser, Val, Thr, Gln, Asn, Lys, His, Ala or Leu;
Xaa at position 55 is Arg, Thr, Val, Ser, Leu, or Gly;
Xaa at position 56 is Pro, Gly, Cys, Ser, Gln, Glu, Arg, His, Thr, Ala, Tyr, Phe, Leu, Val or Lys;
Xaa at position 57 is Asn or Gly;
Xaa at position 58 is Leu, Ser, Asp, Arg, Gln, Val, or Cys;
Xaa at position 59 is Glu Tyr, His, Leu, Pro, or Arg;
Xaa at position 60 is Ala, Ser, Pro, Tyr, Asn, or Thr;
Xaa at position 61 is Phe, Asn, Glu, Pro, Lys, Arg, or Ser;
Xaa at position 62 is Asn, His, Val, Arg, Pro, Thr, Asp, or Ile;
Xaa at position 63 is Arg, Tyr, Trp, Lys, Ser, His, Pro, or Val;
Xaa at position 64 is Ala, Asn, Pro, Ser, or Lys;
Xaa at position 65 is Val, Thr, Pro, His, Leu, Phe, or Ser;
Xaa at position 66 is Lys, Ile, Arg, Val, Asn, Glu, or Ser;
Xaa at position 67 is Ser, Ala, Phe, Val, Gly, Asn, Ile, Pro, or His;
Xaa at position 68 is Leu, Val, Trp, Ser, Ile, Phe, Thr, or His;
Xaa at position 69 is Gln, Ala, Pro, Thr, Glu, Arg, Trp, Gly, or Leu;
Xaa at position 70 is Asn, Leu, Val, Trp, Pro, or Ala;
Xaa at position 71 is Ala, Met, Leu, Pro, Arg, Glu, Thr, Gln, Trp, or Asn;
Xaa at position 72 is Ser, Glu, Met, Ala, His, Asn, Arg, or Asp;
Xaa at position 73 is Ala, Glu, Asp, Leu, Ser, Gly, Thr, or Arg;
Xaa at position 74 is Ile, Met, Thr, Pro, Arg, Gly, Ala;
Xaa at position 75 is Glu, Lys, Gly, Asp, Pro, Trp, Arg, Ser, Gln, or Leu;
Xaa at position 76 is Ser, Val, Ala, Asn, Trp, Glu, Pro, Gly, or Asp;
Xaa at position 77 is Ile, Ser, Arg, Thr, or Leu;
Xaa at position 78 is Leu, Ala, Ser, Glu, Phe, Gly, or Arg;
Xaa at position 79 is Lys, Thr, Asn, Met, Arg, Ile, Gly, or Asp;
Xaa at position 80 is Asn, Trp, Val, Gly, Thr, Leu, Glu, or Arg;
Xaa at position 81 is Leu, Gln, Gly, Ala, Trp, Arg, Val, or Lys;
Xaa at position 82 is Leu, Gln, Lys, Trp, Arg, Asp, Glu, Asn, His, Thr, Ser, Ala, Tyr, Phe, Ile, Met or Val;
Xaa at position 83 is Pro, Ala, Thr, Trp, Arg, or Met;
Xaa at position 84 is Cys, Glu, Gly, Arg, Met, or Val;
Xaa at position 85 is Leu, Asn, Val, or Gln;
Xaa at position 86 is Pro, Cys, Arg, Ala, or Lys;
Xaa at position 87 is Leu, Ser, Trp, or Gly;
Xaa at position 88 is Ala, Lys, Arg, Val, or Trp;
Xaa at position 89 is Thr, Asp, Cys, Leu, Val, Glu, His, Asn, or Ser;
Xaa at position 90 is Ala, Pro, Ser, Thr, Gly, Asp, Ile, or Met;
Xaa at position 91 is Ala, Pro, Ser, Thr, Phe, Leu, Asp, or His;
Xaa at position 92 is Pro, Phe, Arg, Ser, Lys, His, Ala, Gly, Ile or Leu;
Xaa at position 93 is Thr, Asp, Ser, Asn, Pro, Ala, Leu, or Arg;
Xaa at position 94 is Arg, Ile, Ser, Glu, Leu, Val, Gln, Lys, His, Ala, or Pro;
Xaa at position 95 is His, Gln, Pro, Arg, Val, Leu, Gly, Thr, Asn, Lys, Ser, Ala, Trp, Phe, Ile, or Tyr;
Xaa at position 96 is Pro, Lys, Tyr, Gly, Ile, or Thr;
Xaa at position 97 is Ile, Val, Lys, Ala, or Asn;
Xaa at position 98 is His, Ile, Asn, Leu, Asp, Ala, Thr, Glu, Gln, Ser, Phe, Met, Val, Lys, Arg, Tyr or Pro;
Xaa at position 99 is Ile, Leu, Arg, Asp, Val, Pro, Gln, Gly, Ser, Phe, or His;
Xaa at position 100 is Lys, Tyr, Leu, His, Arg, Ile, Ser, Gln, or Pro;
Xaa at position 101 is Asp, Pro, Met, Lys, His, Thr, Val, Tyr, Glu, Asn, Ser, Ala, Gly, Ile, Leu, or Gln;
Xaa at position 102 is Gly, Leu, Glu, Lys, Ser, Tyr, or Pro;
Xaa at position 103 is Asp, or Ser;
Xaa at position 104 is Trp, Val, Cys, Tyr, Thr, Met, Pro, Leu, Gln, Lys, Ala, Phe, or Gly;
Xaa at position 105 is Asn, Pro, Ala, Phe, Ser, Trp, Gln, Tyr, Leu, Lys, Ile, Asp, or His;
Xaa at position 106 is Glu, Ser, Ala, Lys, Thr, Ile, Gly, or Pro;
Xaa at position 108 is Arg, Lys, Asp, Leu, Thr, Ile, Gln, His, Ser, Ala or Pro;
Xaa at position 109 is Arg, Thr, Pro, Glu, Tyr, Leu, Ser, or Gly;
Xaa at position 110 is Lys, Ala, Asn, Thr, Leu, Arg, Gln, His, Glu, Ser, or Trp;
Xaa at position 111 is Leu, Ile, Arg, Asp, or Met;
Xaa at position 112 is Thr, Val, Gln, Tyr, Glu, His, Ser, or Phe;
Xaa at position 113 is Phe, Ser, Cys, His, Gly, Trp, Tyr, Asp, Lys, Leu, Ile, Val or Asn;
Xaa at position 114 is Tyr, Cys, His, Ser, Trp, Arg, or Leu;

Xaa at position 115 is Leu, Asn, Val, Pro, Arg, Ala, His, Thr, Trp, or Met;

Xaa at position 116 is Lys, Leu, Pro, Thr, Met, Asp, Val, Glu, Arg, Trp, Ser, Asn, His, Ala, Tyr, Phe, Gln, or Ile;

Xaa at position 117 is Thr, Ser, Asn, Ile, Trp, Lys, or Pro;

Xaa at position 118 is Leu, Ser, Pro, Ala, Glu, Cys, Asp, or Tyr;

Xaa at position 119 is Glu, Ser, Lys, Pro, Leu, Thr, Tyr, or Arg;

Xaa at position 120 is Asn, Ala, Pro, Leu, His, Val, or Gln;

Xaa at position 121 is Ala, Ser, Ile, Asn, Pro, Lys, Asp, or Gly;

Xaa at position 122 is Gln, Ser, Met, Trp, Arg, Phe, Pro, His, Ile, Tyr, or Cys;

Xaa at position 123 is Ala, Met, Glu, His, Ser, Pro, Tyr, or Leu;

wherein optionally amino acids 1–14 of SEQ ID NO:859 are deleted and/or amino acids 118–133 of SEQ ID NO:859 are deleted; and wherein from 1 to 44 of the amino acids designated by Xaa in SEQ ID NO:859 are different from the corresponding amino acids of native (1–133) human interleukin-3; and (II) a factor selected from the group consisting of: a colony stimulating factor, a cytokine, a lymphokine, an interleukin, and a hematopoietic growth factor; and wherein $L_1$ is a linker capable of linking $R_1$ to $R_2$.

3. The hematopoietic protein as recited in claim 2 wherein $R_2$ is a modified human IL-3 amino acid sequence of (I) selected from the group consisting of;

SEQ ID NO:803; SEQ ID NO:804; SEQ ID NO:805; and SEQ ID NO:806.

4. A hematopoietic protein comprising; an amino acid sequence of the formula:

$Met^{-1} R_1$-$L_1$-$R_2$, $Met^{-2} Ala^{-1} R_1$-$L_1$-$R_2$, $Ala^{-1} R_1$-$L_1$-$R_2$, $R_1$-$L_1$-$R_2$, $Met^{-1} R_2$-$L_1$-$R_1$, $Met^{-2} Ala^{-1} R_2$-$L_1$-$R_1$, $Ala^{-1} R_2$-$L_1$-$R_1$, $R_2$-$L_1$-$R_1$, $Met^{-1} R_1$-$R_2$, $Met^{-2} Ala^{-1} R_1$-$R_2$, $Ala^{-1} R_1$-$R_2$, $R_1$-$R_2$, $Met^{-1} R_2$-$R_1$, $Met^{-2} Ala^{-1} R_2 R_1$, $Ala^{-1} R_2$-$R_1$, or $P_2$-$R_1$, wherein $R_1$ is a biologically active human flt-3 receptor agonist polypeptide, comprising; a modified flt-3 ligand amino acid sequence of the Formula:

```
                                           SEQ ID NO:466
ThrGlnAspCysSerPheGlnHisSerProIleSerSerAspPheAlaVal
                         10

LysIleArgGluLeuSerAspTyrLeuLeuGlnAspTyrProValThrVal
         20                              30

AlaSerAsnLeuGlnAspGluGluLeuCysGlyGlyLeuTrpArgLeuVal
         40                              50

LeuAlaGlnArgTrpMetGluArgLeuLysThrValAlaGlySerLysMet
                         60

GlnGlyLeuLeuGluArgValAsnThrGluIleHisPheValThrLysCys
         70                              80

AlaPheGlnProProProSerCysLeuArgPheValGlnThrAsnIleSer
         90                              100

ArgLeuLeuGlnGluThrSerGluGlnLeuValAlaLeuLysProTrpIle
                         110

ThrArgGlnAsnPheSerArgCysLeuGluLeuGlnCysGlnProAspSer
         120                             130

SerThrLeu
``` wherein optionally from 1 to 7 residues of amino acids 133–139 of SEQ ID NO:466 are deleted; and wherein said modification comprises tire linear rearrangement of SEQ ID NO:466; wherein the N-terminus is joined to the C-terminus directly or through a linker ($L_2$) capable of joining the N-terminus to the C-terminus and new C- and N-termini are created between the amino acid residue pairs of SEQ ID NO:466 selected from the group consisting of:

28–29, 29–30, 30–31, 31–32, 32–33, 34–35, 36–37, 37–38, 38–39, 40–41, 41–42, 42–43, 64–65, 65–66, 66–67, 86–87, 87–88, 88–89, 89–90, 90–91, 91–92, 92–93, 93–94, 94–95, 95–96, 96–97, 97–98, 98–99, 99–100, 100–101, 101–102, and 102–103;

wherein $R_2$ is a factor selected from the group consisting of: a colony stimulating factor, a cytokine, a lymphokine, an interleukin, and a hematopoietic growth factor; and wherein $L_1$ is a linker capable of linking $R_1$ to $R_2$.

5. The hematopoietic protein protein as recited in claim 1, 2, 3, or 4 wherein said linker ($L_2$) is selected from the group consisting of:

Ser; Asn; Gly; Thr; GlySer; AlaAla; GlySerGly; GlyGlyGly; GlyAsnGly; GlyAlaGly; GlyThrGly; AlaSerAla; AlaAlaAla; GlyGlyGlySer SEQ ID NO:778; GlyGlyGlySerGlyGlyGlySer SEQ ID NO:779; GlyGlyGlySerGlyGlyGlyGlySerGlyGlyGlySer SEQ ID NO:780; SerGlyGlySerGlyGlySer SEQ ID NO:781; GluPheGlyAsnMet SEQ ID NO:782; GluPheGlyGlyAsnMet SEQ ID NO:783; GluPheGlyGlyAsnGlyGlyAsnMet SEQ ID NO:784; GlyGlySerAspMetAlaGly SEQ ID NO:785; SerGlyGlyAsnGly SEQ ID NO:786; SerGlyGlyAsnGlySerGlyGlyAsnGly SEQ ID NO:787; SerGlyGlyAsnGlySerGlyGlyAsnGlySerGlyGlyAsnGly SEQ ID NO:788; SerGlyGlySerGlySerGlyGlySerGly SEQ ID NO:789; SerGlyGlySerGlySerGlyGlySerGlySerGlyGlySerGly SEQ ID NO:790; GlyGlyGlySerGlyGly SEQ ID NO:791; GlyGlyGlySerGlyGlyGly SEQ ID NO:792; GlyGlyGlySerGlyGlyGlySerGlyGly SEQ ID NO:793; GlyGlyGlySerGlyGlyGlySerGlyGlyGlySerGly SEQ ID NO:794; GlyGlySerGlyGlyGlySerGlyGlyGlySerGlyGlyGly SEQ ID NO:795; GlyGlyGlySerGlyGlyGlySerGlyGlyGlySerGlyGlyGlySerGlyGlyGlySerGly SEQ ID NO:796; ProProProTrpSerProArgProLeuGlyAlaThrAlaProThrAlaGlyGlnProProLeu SEQ ID NO:797; ProProProTrpSerProArgProLeuGlyAlaThrAlaProThr SEQ ID NO:798; and ValGluThrValPheHisArgValSerGlnAspGlyLeuLeuThrSer SEQ ID NO:799.

6. The hematopoietic protein as recited in claim 1 wherein said protein is selected from the group consisting of: SEQ ID NO:581; SEQ ID NO:582; SEQ ID NO:583; SEQ ID NO:584; SEQ ID NO:585; SEQ ID NO:586; SEQ ID NO:587; SEQ ID NO:588; SEQ ID NO:743; SEQ ID NO:659; and SEQ ID NO:705.

7. The hematopoietic protein of claim 1, 2 or 4, wherein said factor is selected from the group consisting of GM-CSF, G-CSF, G-CSF Ser[17], c-mpl ligand (TPO), M-CSF, erythropoietin (EPO), IL-1, IL-4, IL-2, IL-3, IL-5, IL 6, IL-7, IL-8, IL-9, IL-10, IL-11, IL-12, IL-13, IL-15, LIF, flt3 ligand, and stem cell factor (SCF).

8. The hematopoietic protein of claim 7 wherein said colony stimulating factor is selected from the group consisting of G-CSF, G-CSF Ser[17], G-CSF Ala[17] and c-mpl ligand (TPO).

9. A nucleic acid molecule encoding said hematopoietic protein of claim 1.

10. A nucleic acid molecule encoding said hematopoietic protein of claim 2.

11. A nucleic acid molecule encoding said hematopoietic protein of claim 3.

12. A nucleic acid molecule encoding said hematopoietic protein of claim 4.

13. A nucleic acid molecule encoding said hematopoietic protein of claim 5.

14. A nucleic acid molecule encoding said hematopoietic protein of claim 6.

15. A nucleic acid molecule encoding said hematopoietic protein of claim 7.

16. A nucleic acid molecule encoding said hematopoietic protein of claim 8.

17. The nucleic acid molecule according to claim 9 selected from group consisting of:
   SEQ ID NO:121; SEQ ID NO:122; SEQ ID NO:123; SEQ ID NO:124; SEQ ID NO:125; SEQ ID NO:126; SEQ ID NO:127; SEQ ID NO:128; SEQ ID NO:282; SEQ ID NO:198; and SEQ ID NO:244.

18. A method of producing a hematopoietic protein comprising; growing under suitable nutrient conditions, a host cell transformed or transfected with a replicable vector comprising a nucleic acid molecule of claim 9, 10, 11, 12, 14, or 17 in a manner allowing expression of said hematopoietic protein and recovering said hematopoietic protein.

19. A method of producing a hematopoietic protein comprising; growing under suitable nutrient conditions, a host cell transformed or transfected with a replicable vector comprising a nucleic acid molecule of claim 13 in a manner allowing expression of said hematopoietic protein and recovering said hematopoietic protein.

20. A method of producing a hematopoietic protein comprising; growing under suitable nutrient conditions, a host cell transformed or transfected with a replicable vector comprising a nucleic acid molecule of claim 15 in a manner allowing expression of said hematopoietic protein and recovering said hematopoietic protein.

21. A method of producing a hematopoietic protein comprising; growing under suitable nutrient conditions, a host cell transformed or transfected with a replicable vector comprising a nucleic acid molecule of claim 16 in a manner allowing expression of said hematopoietic protein and recovering said hematopoietic protein.

22. A pharmaceutical composition comprising; the hematopoietic protein according to claim 1, 2, 3, 4, or 6; and a pharmaceutically acceptable carrier.

23. A pharmaceutical composition comprising; the hematopoietic protein according to claim 5; and a pharmaceutically acceptable carrier.

24. A pharmaceutical composition comprising; the hematopoietic protein according to claim 7; and a pharmaceutically acceptable carrier.

25. A pharmaceutical composition comprising; the hematopoietic protein according to claim 8; and a pharmaceutically acceptable carrier.

26. A method of stimulating the production of hematopoietic cells in a patient comprising the step of; administering an effective amount of the hematopoietic protein as recited in claim 1, 2, 3, 4, or 6 to said patient.

27. A method of stimulating the production of hematopoietic cells in a patient comprising the step of; administering an effective amount of the hematopoietic protein as recited in claim 5 to said patient.

28. A method of stimulating the production of hematopoietic cells in a patient comprising the step of; administering an effective amount of the hematopoietic protein as recited in claim 7 to said patient.

29. A method of stimulating the production of hematopoietic cells in a patient comprising the step of; administering an effective amount of the hematopoietic protein as recited in claim 8 to said patient.

30. A method for treating a human having a tumor, infection or auto-immune disease, comprising the step of; administering to said human an amount of the hematopoietic protein of claim 1, 2, 3, 4, or 6 effective to promote the production of hematopoietic cells.

31. A method for treating a human having a tumor, infection or auto-immune disease, comprising the step of; administering to said human an amount of the hematopoietic protein of claim 5 effective to promote the production of hematopoietic cells.

32. A method for treating a human having a tumor, infection or auto-immune disease, comprising the step of; administering to said human an amount of the hematopoietic protein of claim 7 effective to promote the production of hematopoietic cells.

33. A method for treating a human having a tumor, infection or auto-immune disease, comprising the step of; administering to said human an amount of the hematopoietic protein of claim 8 effective to promote the production of hematopoietic cells.

34. The method of claim 30, further comprising the step of; administering an antigen to said patient.

35. The method of claim 31, further comprising the step of; administering an antigen to said patient.

36. The method of claim 32, further comprising the step of; administering an antigen to said patient.

37. The method of claim 33, further comprising the step of; administering an antigen to said patient.

* * * * *